US011576958B2

(12) United States Patent
Malley et al.

(10) Patent No.: US 11,576,958 B2
(45) Date of Patent: *Feb. 14, 2023

(54) PROTEIN ANTIGENS THAT PROVIDE PROTECTION AGAINST PNEUMOCOCCAL COLONIZATION AND/OR DISEASE

(71) Applicant: CHILDREN'S MEDICAL CENTER CORPORATION, Boston, MA (US)

(72) Inventors: Richard Malley, Beverly, MA (US); Yingjie Lu, West Roxbury, MA (US); Fan Zhang, West Roxbury, MA (US)

(73) Assignee: CHILDREN'S MEDICAL CENTER CORPORATION, Boston, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/766,252

(22) PCT Filed: Feb. 7, 2014

(86) PCT No.: PCT/US2014/015254
§ 371 (c)(1),
(2) Date: Aug. 6, 2015

(87) PCT Pub. No.: WO2014/124228
PCT Pub. Date: Aug. 14, 2014

(65) Prior Publication Data
US 2015/0374811 A1   Dec. 31, 2015

Related U.S. Application Data

(60) Provisional application No. 61/762,062, filed on Feb. 7, 2013.

(51) Int. Cl.
*A61K 39/09* (2006.01)
*C07K 14/315* (2006.01)
*A61K 39/00* (2006.01)

(52) U.S. Cl.
CPC ........ *A61K 39/092* (2013.01); *C07K 14/3156* (2013.01); *A61K 2039/55505* (2013.01); *A61K 2039/6087* (2013.01); *A61K 2039/625* (2013.01); *Y02A 50/30* (2018.01)

(58) Field of Classification Search
None
See application file for complete search history.

(56) References Cited

U.S. PATENT DOCUMENTS

| | | |
|---|---|---|
| 6,287,568 B1 | 9/2001 | Wang et al. |
| 7,217,791 B2 | 5/2007 | Chen et al. |
| 7,585,669 B2 | 9/2009 | Chen et al. |
| 9,499,593 B2 | 11/2016 | Malley et al. |
| 10,017,548 B2 | 7/2018 | Malley et al. |
| 11,013,793 B2 | 5/2021 | Malley et al. |
| 2002/0032323 A1 | 3/2002 | Kunsch et al. |
| 2005/0002948 A1 | 1/2005 | Ryall |
| 2005/0226899 A1 | 10/2005 | Castiglioni et al. |
| 2006/0251675 A1 | 9/2006 | Hagan |
| 2007/0082005 A1 | 4/2007 | Doucette-Stamm |
| 2007/0128183 A1 | 6/2007 | Meinke et al. |
| 2007/0184443 A1 | 8/2007 | Covacci |
| 2008/0032340 A1 | 2/2008 | Ghosh et al. |
| 2008/0112964 A1 | 5/2008 | Kirkham et al. |
| 2008/0160045 A1 | 7/2008 | Contorni et al. |
| 2009/0054251 A1 | 2/2009 | O'Connor et al. |
| 2009/0068288 A1 | 3/2009 | Kruger |
| 2009/0148894 A1 | 6/2009 | Broedel et al. |
| 2009/0148897 A1 | 6/2009 | Dai |
| 2009/0285846 A1 | 11/2009 | Tweten |

(Continued)

FOREIGN PATENT DOCUMENTS

| | | | | |
|---|---|---|---|---|
| GB | WO 0006738 A2 * | 2/2000 | ......... | C07K 14/3156 |
| WO | 90-11087 A1 | 10/1990 | | |

(Continued)

OTHER PUBLICATIONS

Nordlund et al. (Biochemistry Journal, vol. 392, pp. 485-491).*
Skolnick et al. (Trends in Biotechnology 18: 34-39, 2000).*
Bowie et al., "Deciphering the message in protein sequences: tolerance to amino acid substitutions", Science 257:1306-1310 (1990).
Extended European Search Report Corresponding Eurpean Application No. 11754142.5 dated Oct. 29, 2013.
Greenspan et al., "Defining epitopes: It's not easy as it seems", Nature Biotechnoly 17:936-937 (1999).
Ling et al., "Glycolytic enzymes associated with the cell surface of Streptococcus pneumoniae are antigenic in humans and elicit protective immune responses in the mouse", Clin. Exp. Immunol 138:290-298 (2004).

(Continued)

*Primary Examiner* — Robert A Zeman
(74) *Attorney, Agent, or Firm* — Nixon Peabody LLP; David S. Resnick; Susanna C. Benn

(57) ABSTRACT

The present application is generally directed to novel pneumococcal polypeptide antigens and nucleic acids encoding such antigens, and immunogenic compositions comprising such antigens for treating and preventing pneumococcal infection. The present invention further provides method of using the antigens to elicits an immune response (e.g., IL-17A response, a T cell-mediated and/or B-cell-mediated immune responses). The present invention also provides methods of prophylaxis and/or treatment of pneumococcal-mediated diseases, such as sepsis, comprising administering an immunogenic composition including one or more of a combination of pneumococcal antigens or functional fragments thereof as disclosed herein. In some embodiments, one or more pneumococcal antigens can be present in a polysaccharide conjugate. The compositions induce an anti-pneumococcus immune response when administered to a mammal. The compositions can be used prophylactically to vaccinate an individual and/or therapeutically to induce a therapeutic immune response to an infected individual.

16 Claims, 7 Drawing Sheets

Specification includes a Sequence Listing.

(56) References Cited

U.S. PATENT DOCUMENTS

| | | | |
|---|---|---|---|
| 2010/0003266 | A1 | 1/2010 | Simon |
| 2010/0020945 | A1 | 1/2010 | Li et al. |
| 2010/0022401 | A1 | 1/2010 | Nordlund et al. |
| 2010/0166802 | A1 | 7/2010 | Caplan et al. |
| 2010/0209450 | A1 | 8/2010 | Biemans et al. |
| 2010/0330112 | A1 | 12/2010 | Long et al. |
| 2011/0020386 | A1 | 1/2011 | Gierahn et al. |
| 2011/0065660 | A1 | 3/2011 | Baron et al. |
| 2011/0159040 | A1 | 6/2011 | Malley et al. |
| 2011/0293664 | A1 | 12/2011 | Cohane et al. |
| 2012/0135025 | A1 | 5/2012 | Flechtner et al. |
| 2012/0189649 | A1 | 7/2012 | Gierahn et al. |
| 2012/0251577 | A1 | 10/2012 | Malley et al. |
| 2013/0115230 | A1 | 5/2013 | Simon |
| 2013/0121958 | A1 | 5/2013 | LeClerc et al. |
| 2014/0154286 | A1 | 6/2014 | Malley et al. |
| 2014/0154287 | A1 | 6/2014 | Malley et al. |
| 2016/0090404 | A1 | 3/2016 | Malley et al. |
| 2017/0021006 | A1 | 1/2017 | Watson et al. |
| 2019/0119335 | A1 | 4/2019 | Malley et al. |
| 2020/0087361 | A1 | 3/2020 | Malley et al. |
| 2020/0222522 | A1 | 7/2020 | Malley et al. |
| 2020/0407404 | A1 | 12/2020 | Malley et al. |

FOREIGN PATENT DOCUMENTS

| | | | | |
|---|---|---|---|---|
| WO | 1995021195 A1 | 8/1995 | | |
| WO | 1996029094 A1 | 9/1996 | | |
| WO | 199818930 A2 | 5/1998 | | |
| WO | 1998047530 A2 | 10/1998 | | |
| WO | 1999/003884 A2 | 1/1999 | | |
| WO | 00/06737 A2 | 2/2000 | | |
| WO | 2001/040472 A2 | 6/2001 | | |
| WO | 02/077021 A2 | 10/2002 | | |
| WO | 2003/044185 A2 | 5/2003 | | |
| WO | 2003094960 A2 | 11/2003 | | |
| WO | 2004/092209 A2 | 10/2004 | | |
| WO | 2004092209 A2 | 10/2004 | | |
| WO | 2005037190 A2 | 4/2005 | | |
| WO | 2005039501 A2 | 5/2005 | | |
| WO | 2006017929 A1 | 2/2006 | | |
| WO | 2006067632 A2 | 6/2006 | | |
| WO | 2006/084467 A1 | 8/2006 | | |
| WO | 2007026249 A2 | 3/2007 | | |
| WO | 2007067681 A2 | 6/2007 | | |
| WO | 2007081583 A2 | 7/2007 | | |
| WO | 2007150020 A1 | 12/2007 | | |
| WO | 2008094986 A2 | 8/2008 | | |
| WO | 2008/119358 A2 | 10/2008 | | |
| WO | 2008152448 A2 | 12/2008 | | |
| WO | 2009021548 A1 | 2/2009 | | |
| WO | WO 2009016515 A2 * | 2/2009 | ........... | A61K 39/092 |
| WO | M09029831 A1 | 3/2009 | | |
| WO | 2009/143413 A1 | 11/2009 | | |
| WO | 2010053559 A1 | 5/2010 | | |
| WO | 2010071986 A1 | 7/2010 | | |
| WO | 2010081875 A1 | 7/2010 | | |
| WO | 2011008548 A1 | 1/2011 | | |
| WO | 2011137354 A2 | 11/2011 | | |
| WO | 2012/155007 A1 | 11/2012 | | |
| WO | 2012155053 A1 | 11/2012 | | |
| WO | WO 2012155007 A1 * | 11/2012 | ........... | A61K 39/092 |
| WO | 2014018904 A1 | 1/2014 | | |
| WO | 2017013548 A1 | 1/2017 | | |
| WO | 2020056127 A1 | 3/2020 | | |
| WO | 2020056202 A2 | 3/2020 | | |

OTHER PUBLICATIONS

Portnoi et al., "The vaccine potential of *Streptococcus pneumoniae* surface lectin- and non-lectin proteins", Vaccine 24:1868-1873 (2006).

Vickerman et al., "Genome-wide transcriptional changes in *Streptococcus gordonii* in response to competence signaling peptide", Journal of Bacteriology 189(21):7799-7807 (2007).

Lu et al., "Interleukin-17A Mediates Acquired Immunity to Pneumococcal Colonization." PLoS Pathogens, 4(9):1-11 (2008).

Malley et al., "Intranasal Immunization with Killed Unencapsulated Whole Cells Prevents Colonization and Invasive Disease by Capsulated Pneumococci." Infection and Immunity, 69(8):14870-4873 (2001).

Malley et al., "Multiserotype Protection of Mice Against Pneumococcal Colonization of the Nasopharynx and Middle Ear by Killed Nonencapsulated Cells Given Intranasally with a Nontoxic Adjuvant." Infection and Immunity, 72(7):14290-4292 (2004).

Malley et al., "CD4+ T Cells Mediate Antibody-Independent Acquired Immunity to Pneumococcal Colonization." PNAS, 102(13):14848-4853 (2005).

Trzcinski et al., "Antibodies to Conserved Pneumococcal Antigens Correlate with, but Are Not Required for, Protection Against Pneumococcal Colonization Induced by Prior Exposure in a Mouse Model." Infection and Immunity, 73(10):17043-7046 (2005).

Basset et al., "Antiboby-independent, CD4+ T-Cell-Dependent protection against pneumococcal colonization elicited by intranasal immunization with purified pneumococcal proteins" Infection and Immunity, 75(11):15460-5464 (2007).

Laine et al., "Age-specific immunoglobulin G (IgG) and IgA to pneumococcal protein antigens in a population in coastal Kenya" Infection and Immunity, 72(6):13331-3335 (2004).

Malley, "Antibody and cell-mediated immunity to *Streptococcus pneumoniae:* implications for vaccine development" Journal of Molecular Medicine, 88(2):135-142 (2010).

Moffit et al., "TH17-Based vaccine design for prevention of *Streptococcus pneumoniae* colonization" Cell Host and Microbe, 9:158-165 (2011).

Lu et al., "Protection against Pneumococcal Colonization and Fatal Pneumonia by a Trivalent Conjugate of a Fusion Protein with the Cell Wall Polysaccharide" Infection and Immunity, 77(5):2076-2083 (2009).

Lu et al., "A Bivalent Vaccine to Protect against *Streptococcus pneumoniae* and *Salmonella typhi*", Vaccine, 30(23):3405-3412 (2012).

Moffit et al., "Identification of protective pneumococcal T(H)7 antigens from the soluble fraction of a killed whole cell vaccine", PLoS One, 7(8):e43445 (2012).

Wizemann et al., "Use of a whole Genome Approach to Identify Vaccine Molecules Affording Protection against *Streptococcus pneumoniae* Infection" Infection and Immunity 69(3):1593-1598 (2001).

Hytonen, V.P. et al., Efficient production of active chicken avidin using a bacterial signal peptide in *Escherichia coli*, Biochem J., 384(Pt 2): 385-90 (2004).

Insel, R. et al., Response to oligosaccharide-protein conjugate vaccine against Hemophilus influenzae b in two patients with IgG2 deficiency unresponsive to capsular polysaccharide vaccine, N. Engl J. Med., 315:8, p. 499-503 (1986).

International Search Report for PCT/US19/50800, 4 pages (dated Dec. 31, 2019).

International Search Report for PCT2019050907, 5 pages (dated Feb. 2, 2020).

International Search Report for PCT/US2012/037412 (Multiple Antigen Presenting Immunogenic Composition, and Methods and Uses Thereof, filed May 11, 2012), issued by ISA/FIPS, 3 pages (Aug. 23, 2012).

International Search Report for PCT/US2012/037541 (Modified Biotin-Binding Protein, Fusion Proteins Thereof and Applications, filed May 11, 2012), issued by ISA/FIPS, 4 pages (Aug. 30, 2012).

Ishizaka, S.T, and Hawkins, L.D., E6020: a synthetic Toll-like receptor 4 agonist as a vaccine adjuvant, Expert Rev. Vaccines, 6(5):773-784 (2007).

Izard, J. W. and Kendall, D. A., Signal peptides: exquisitely designed transport promoters, Mol. Microbiol. 13(5):765-73 (1994).

Jin, Z. et al., Conjugates of group A and W135 capsular polysaccharides of neisseria meningitidis bound to recombinant *Staphylo-*

(56) References Cited

OTHER PUBLICATIONS coccus aureus enterotoxin C1: preparation, physicochemical characterization, and immunological properties in mice, Infect Immun, 73(12):7887-7893 (2005).
Kehoe, M. et al., Cloning, Expression, and Mapping of the *Staphylococcus aureus* a-Hemolysin Determinant in *Escherichia coli* K-12, 41(3):1105-1111 (1985).
Kim, K. H. et al., Efficiency of a Pneumococcal Opsonophagocytic Killing Assay improved by Multiplexing and by Coloring Colonies, Clin. Diagn. Lab. Immunol., 10(4):616-621 (2003).
Kojima, K. et al., Quantitation of IgG subclass antibodies to pneumococcal capsular polysaccharides by ELISA, using Pneumovax-specific antibodies as a reference, Tohoku J. Exp. Med., 161(3):209-215 (1990).
Koskela, M. and Leinonen, M., Comparison of ELISA and RIA for measurement of pneumococcal antibodies before and after vaccination with 14-valent pneumococcal capsular polysaccharide vaccine, J. Clin. Pathol., 34(1):93-98 (1981).
Lees, A. et al., Enhanced immunogenicity of protein-dextran conjugates: I. Rapid stimulation of enhanced antibody responses to poorly immunogenic molecules, Vaccine, 12(13): 1160-1166 (1994).
Martinez, J. E. et al., A flow cytometric opsonophagocytic assay for measurement of functional antibodies elicited after vaccination with the 23-valent pneumococcal polysaccharide vaccine, Clin. Diagn. Lab Immunol., 6(4):581-586 (1999).
Munro, C. S. et al., Assessment of biological activity of immunoglobulin preparations by using opsonized micro-organisms to stimulate neutrophil chemiluminescence, Clin. Exp. Immunol., 61(1):183-188 (1985).
Nuorti, J. P. and Whitney, C. G., Prevention of pneumococcal disease among infants and children—use of 13-valent pneumococcal conjugate vaccine and 23-valent pneumococcal polysaccharide vaccine, Morbidity and Mortality Weekly Report, 59:1-24 (2010).
Ojo-Amaize, E. A. et al., A rapid and sensitive chemiluminescence assay for evaluation of functional opsonic activity of Haemophilus influenzae type b-specific antibodies, Clin. Diagn. Lab. Immunol., 2(3):286-290 (1995).
O'Reilly, M. et al., Inactivation of the alpha-haemolysin gene of *Staphylococcus aureus* 8325-4 by site-directed mutagenesis and studies on the expression of its haemolysins, Microbial Pathogenesis, 1:125-138 (1986).
Paton, P. C. et al., Purification and immunogenicity of genetically obtained pneumolysin toxoids and their conjugation to *Streptococcus pneumoniae* type 19F polysaccharide, Infect. Immun., 59(7):2297-2304 (1991).
PNEUMOVAX® 23 (prescribing information). Whitehouse Station, NJ: Merck & Co.; May 2015.
Poljak, R. J., Production and structure of diabodies. Structure. 2(12):1121-1123 (1994).
Pollabauer, E. M. et al., The influence of carrier protein on the immunogenicity of simultaneously administered conjugate vaccines in infants, Vaccine, 27(11): 1674-1679 (2009).
PREVNAR 13® (prescribing information). New York, NY: Pfizer; Aug. 2017.
Richter, S. S. et al., Changes in pneumococcal serotypes and antimicrobial resistance after introduction of the 13 valent conjugate vaccine in the United States, Antimicrob Agents Chemother., 58:6484-6489 (2014).
Romero-Steiner, S. et al., Avidity determinations for Haemophilus influenzae Type b anti-polyribosylribitol phosphate antibodies, Clin. Diagn. Lab. Immunol., 12(9):1029-1035 (2005).
Romero-Steiner, S. et al., Standardization of an opsonophagocytic assay for the measurement of functional antibody activity against *Streptococcus pneumoniae* using differentiated HL-60 cells, Clin. Diagn. Lab. Immunol., 4(4):415-422 (1997).
Rosenberg, I.M., Protein Analysis and Purification, Springer Science + Business Media New York, 153-182 (1996).
Saeland, E. et al., Pneumococcal pneumonia and bacteremia model in mice for the analysis of protective antibodies, Microb, Pathog., 29(2):81-91 (2000).
Sanabria-Valentin, Dissertation, Department of Basic Medical Sciences, NYU, p. 8-9 describing the general structure of LPS (2008).
Sano, T. et al., Methods in Enzymology, Elsevier, 326: 305-307 (2000).
Saunders, F. K. et al., Pneumolysin, the thiol- activated toxin of *Streptococcus pneumoniae*, does not require a thiol group for in vitro activity, Infect, Immun. 57(8):2547-2552 (1989).
Scott, D. et al., Immunogenicity of biotinylated hapten-avidin complexes, Mol. Immunol., 21(11):1055-1060 (1984).
Sen, G. et al., In vivo humoral immune responses to isolated Pneumococcal polysaccharides are dependent on the presence of associated TLR ligands, The Journal of immunology, 175(5):3084-3091 (2005).
Singh, M. and Indresh S., Advances in vaccine adjuvants for infectious diseases, Current HIV research 1(3):309-320 (2003).
Stack, A. M. et al., Minimum protective serum concentrations of pneumococcal anti-capsular antibodies in infant rats, J. Infect. Dis., 177(4):986-990 (1998).
Takakura, Y. et al., Tamavidin, a versatile affinity tag for protein purification and immobilization, J. Biotechnol., 145(4): 317-322 (2010).
Thermo Scientific Avidin-Biotin Technical Handbook, 2009, p. 16-17. Found on the Internet on May 5, 2016 at: https://www.thermofisher.com/content/dam/LifeTech/Images/integration/1601675_AvBi_HB_INTL.pdf.
Wardenburg, J. and Schneewind, O., Vaccine protection against *Staphylococcus aureus* pneumonia, J. Exp. Med., 205(2): 287-94 (2008).
Williams et al., Innate imprinting by the Modified Heat-Labile Toxin of *Escherichia coli* (LTK63) Provides Generic Protection against Lung Infectious Disease, The Journal of Immunology, 173: 7435-7443 (2004).
Written Opinion for PCT/US19/50800, 8 pages (dated Dec. 31, 2019).
Written Opinion for PCT/US2012/037412 (Multiple Antigen Presenting Immunogenic Composition, and Methodsand Uses Thereof, filed May 11, 2012), issued by ISA/FIPS, 4 pages (Aug. 23, 2012).
Written Opinion for PCT/US2012/037541 (Modified Biotin-Binding Protein, Fusion Proteins Thereof and Applications, filed May 11, 2012), issued by ISA/FIPS, 3 pages (Aug. 30, 2012).
Written Opinion for PCT2019050907, 6 pages (dated Feb. 2, 2020).
Wu, W. et al., Th1 7-stimulating protein vaccines confer protection against Pseudomonas aeruginosa pneumonia, Am. J. Respir. Grit. Care Med., 186(5):420-427 (2012).
Zhang, F. et al., Design and evaluation of multiple antigen presenting system (MAPS)-based pneumococcal vaccine to prevent invasive disease and carriage, poster presented at the 10th International Symposium on Pneumococci and Pneumococcai Diseases (ISPPD-10), Glasgow, Scotland, Jun. 26-30, 2016.
Helppolainen, S. H. et al, Bradavidin II from Bradyrhizobiumjaponicum: a new avidin-like biotin-binding protein, Biochim. Biophys. Acta., 1784(7-8):1002-10 (2008).
Helppolainen, S.H. et al., Rhizavidin from Rhizobium etli: the first natural dimer in the avidin protein family, Biochem J., 405(3): 397-405 (2007).
Hermanson, G. T., Bioconjugate Techniques, Elsevier Science, ProQuest Ebook Central, http://ebookcentral.proquest.com/lib.uspto-ebooks/detail.action?docID=307203, created from USPTO-ebooks on Sep. 6, 2017, 570-592 (1996).
Holliger, P. et al., "Diabodies": small bivalent and bi specific antibody fragments, Proc. Natl. Acad, Sci, USA, 90:6444-6448 (1993).
Hsu, T-L. et al, Profiling Carbohydrate-Receptor Interaction with Recombinant Innate Immunity Receptor-Fc Fusion Proteins, J. Biol. Chem., 284(50): 34479-34489 (2009).
Huang, H. et al., Robust stimulation of humoral and cellular immune responses following vaccination with antigen-loaded beta-glucan particles, MBio, 1(3):e00164-10 (2010).
International Search Report for PCT/US2014/015254 (Protein Antigens That Provide Protection Against Pneumococcal Colonization and/or Disease, filed Feb. 7, 2014) Issued by ISA/210, 4 pgs (Aug. 14, 2015).

(56) References Cited

OTHER PUBLICATIONS

Written Opinion for PCT/US2014/015254 (Protein Antigens That Provide Protection Against Pneumococcal Colonization and/or Disease, filed Feb. 7, 2014) Issued by ISA/237, 5 pgs (Aug. 7, 2015).
Zhang et al., "Multiple antigen-presenting system (MAPS) to induce comprehensive B- and T-cell immunity", PNAS 110(33):13564-13569 (2013).
Ahmad et al., "Sequential release of antigens from chloroform-treated *Staphylococcus epidermidis:* application towards a possible vaccine", J Appl Bacteriol 69(5) 676-685 (1990).
Beghetto et al., "Discovery of novel *Streptococcus pneumoniae* antigens by screening a whole-genome lambdadisplay library", FEMS Microbiol Lett 262(1) 14-21 (2006).
Boslego et al., "Gonorrhea Vaccines" Vaccine and Immunotherapy Ch. 17 211 (1991).
Ellis, "New Technologies for making vaccines" Vaccine Ch. 29 568-574 (1988).
International Search Report for PCT/US11/28052 (Novel Immunogens and Methods for Discovery and Screening Thereof, filed Mar. 11, 2011) issued by ISA/KR, 6 pages (dated Dec. 27, 2011).
Written Opinion for PCT/US11/28052 (Novel Immunogens and Methods for Discovery and Screening Thereof, filed Mar. 11, 2011) issued by ISA/KR, 6 pages (dated Dec. 27, 2011).
"Centers for Disease Control and Prevention. ""Preventing pneumococcal disease among infants and young children.""Morbidity and Mortality Weekly Report 49: 1-55 (2000)"
Anttila, M. et al., Avidity of IgG for Streptococcus pneumoniae type 6B and 23F polysaccharides in infants primed with pneumococcal conjugates and boosted with polysaccharide or conjugate vaccines, J. Infect. Dis., 177 (6):1614-1621 (1998).
AVCI, F.Y. et al, a mechanism for glycoconjugate vaccine activation of the adaptive immune system and its implications or vaccine design, Nat. Med., 17(12): 1602-1609 (2011).
Berry, M. A. et al., Effect of Defined Point Mutations in Pneumolysin Gene on the Virulence of Streptococcus pneumonia, Infection and Immunity, 63(5):1969-1974 (1995).
Caierao, J. et al., Characteristics of serogroup 20 S.pneumoniae isolates from Brazil, Bmc Infectious Diseases, 16:418 (2016).
Centers for Disease Control and Prevention. "Prevention of pneumococcal disease among infants and children—use of 13-valent pneumococcal conjugate vaccine and 23-valent pneumococcal polysaccharide vaccine." Morbidity and Mortality Weekly Report 59: 1-24 (2010).
Colino, J. et al, Non-covalent association of protein and capsular polysaccharide on bacteria-sized latex beads as a model for polysaccharide-specific humoral immunity to intact Gram-positive extracellular bacteria, J. Immunol., 191(6): 3254-3263 (2013).
Colino, J. et al, Parameters Underlying Distinct T Cell-Dependent Polysaccharide-Specific IgG Responses to an Intact Gram-Positive Bacterium versus a Soluble Conjugate Vaccine, the Journal of Immunology, 1552-1559 (2009).
Crtajarena, A.L., et al, A receptor-binding region in *Escherichia coli* alpha-haemolysin, J. Biol. Chem., 278 (21):19159-63 (2003).

Dagan, R. et al., Glycoconjugate vaccines and immune interference: a review, Vaccine, 28(34): 5513-5523 (2010).
Daniels, C. C. et al., The Proline-Rich Region of Pneumococcal Surface Proteins A and C Contains Surface-Accessible Epitopesn Common to All Pneumococci and Elicits Antibody-Mediated Protection against Sepsis, Infection and Immunity, 78(5):2163-2172 (2010).
Database, UniProt KB/TrEMBL, B3Q265_RHIE6, retrieved Jan. 3, 2021.
Database, UniProt KB/TrEMBL, F2AA21_RHIET, retrieved Jan. 4, 2021.
Database, UniProt KB/TrEMBL, Q8KKW2_RHIEC, retrieved Jan. 4, 2021.
Douce. G. et al., Genetically detoxified mutants of heat-labile toxin from *Escherichia coli* are able to act as oral adjuvants, Infect Immun., 67(9):4400-4406 (1999).
Douce, G. et al., Mutants of *Escherichia coli* heat-labile toxin lacking ADP-ribosyltransferase activity act as non-toxic, mucosal adjuvants, PNAS 92:1644-1648 (1995).
Elgert, K. D., Immunology Understanding the Immune System, John Wiley & Sons, Inc. Hoboken, New Jersey, p. 111 (2009).
EP Communication dated Apr. 9, 2015 in corresponding EP Application No. 12781636.1.
Evans, J. T. et al., Enhancement of antigen-specific immunity via the TLR4 ligands MPL adjuvant and Ribi.529, Expert Rev Vaccines, 2(2):219-229 (2003).
Fauvart, M. et al, Genome Sequence of Rhizobium etli CNPAF512, a Nitrogen-Fixing Symbiont Isolated from Bean Root Nodules in Brazil, Journal of Bacteriology, 193(12): 3158-3159 (2011).
Ferreria, D. M. et al., DNA vaccines based on genetically detoxified derivatives of pneumolysin fail to protect mice against challenge with Streptococcus pneumonia, FEMS Immunology Med. Microbial 46: 291-297 (2006).
Gaj, T. et al., the AviD-tag, a NeutrAvidin/avidin specific peptide affinity tag for the immobilization and purification of recombinant proteins, Protein Expr. Purif., 56(1):54-61 (2007).
Giuliani, M. M. et al., Mucosal adjuvanticity and immunogenicity of LTR72, a novel mutant of *Escherichia coli* heat-labile enterotoxin with partial knockout of ADP-ribosyltransferase activity, J. Exp. Med., 187(7):1123-1132 (1998).
González, V. et al, The mosaic structure of the symbiotic plasmid of Rhizobium etli CFN42 and its relation to other symbiotic genome compartments, Genome Biol., 4(6): R36 (2003).
Gruber, M.F. et al., Pratt D, Haase M. Licensing of pneumococcal conjugate vaccines for children and adults: Regulatory perspective from the European Medicines Agency and the U.S. Food and Drug Administration, Pneumococcal Vaccines: The Impact of Conjugate Vaccine, 183-96 (2008).
Grun, C. H. et al, One-step biotinylation procedure for carbohydrates to study carbohydrate-protein interactions, Anal. Biochem., 354(1):54-63 (2006).

\* cited by examiner

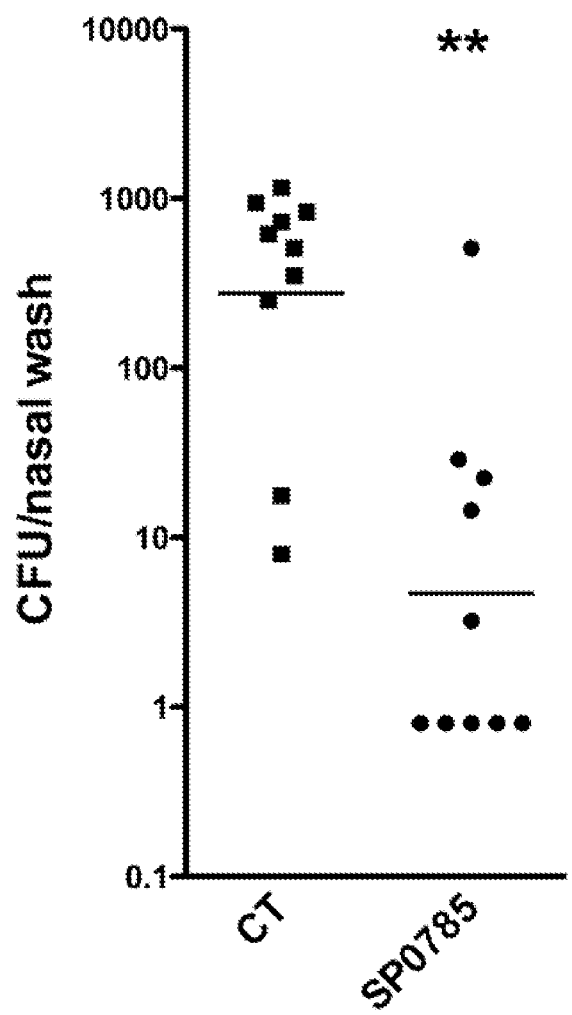
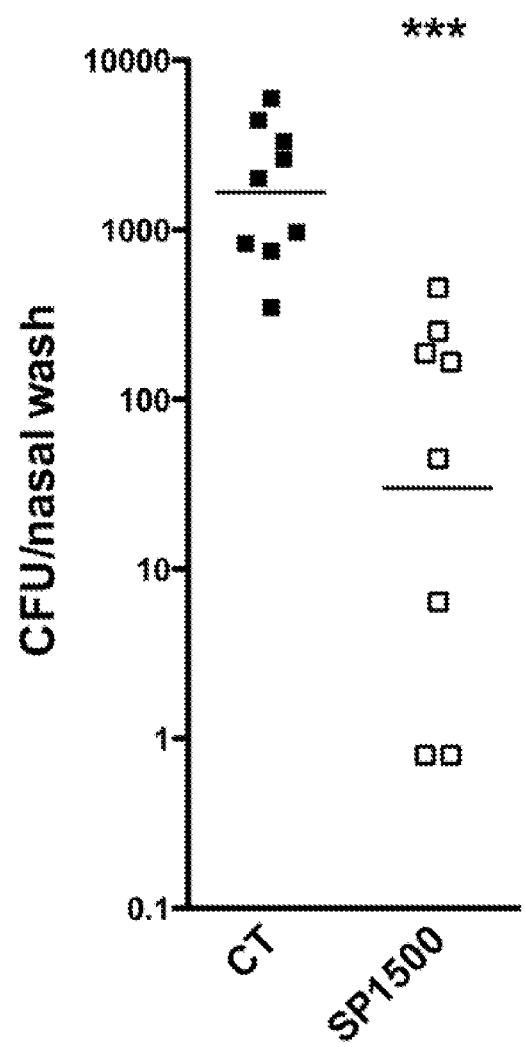
FIG. 1A
FIG. 1B

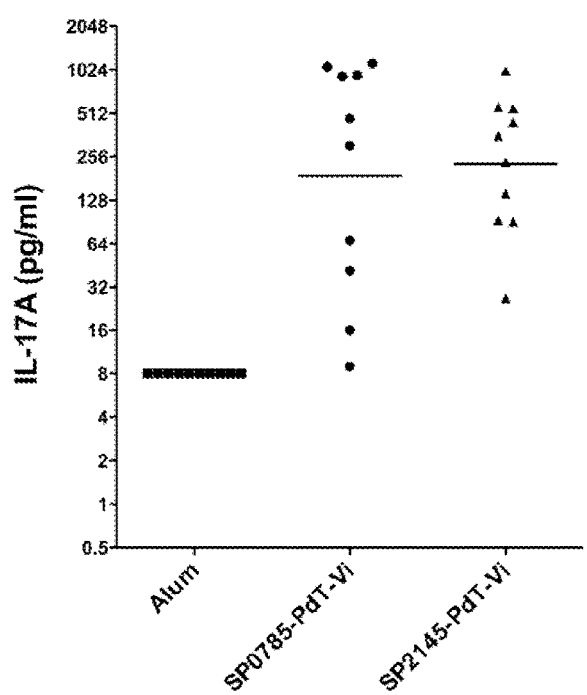 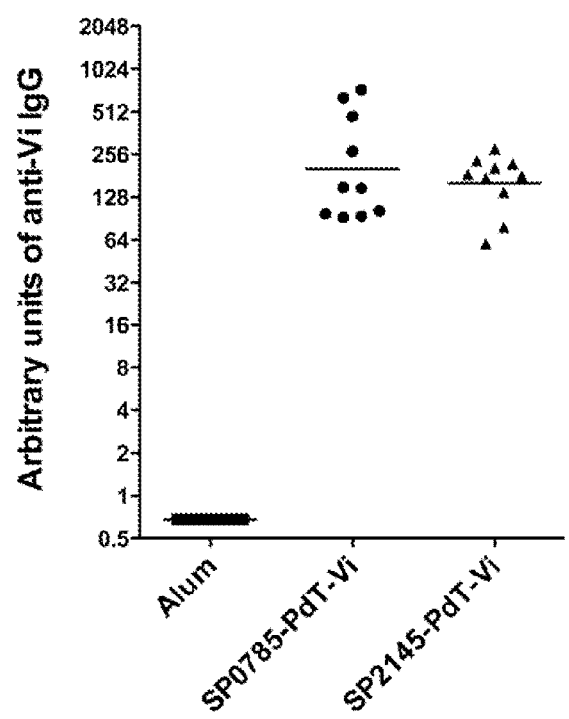
*FIG. 3A*        *FIG. 3B*

PROTEIN ANTIGENS THAT PROVIDE PROTECTION AGAINST PNEUMOCOCCAL COLONIZATION AND/OR DISEASE

CROSS REFERENCE TO RELATED APPLICATIONS

This application is a 371 National Phase Entry of International Patent Application No. PCT/US2014/015254 filed on Feb. 7, 2014 which claims benefit under 35 U.S.C. § 119(e) of U.S. Provisional Patent Application Ser. No. 61/762,062 filed Feb. 7, 2013, the contents of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Feb. 6, 2014, is named 701039-074841-PCT_SL.txt and is 640,188 bytes in size.

FIELD OF THE INVENTION

The present application is generally directed to methods for identifying immunogens from organisms and pathogens, and in particular for identifying immunogens which when administered as vaccines elicit a cellular and/or humoral immune response. The present application is also directed to pneumococcal T-cell immunogens, and methods and compositions thereof.

BACKGROUND OF THE INVENTION

Almost one million children in the developing world die of pneumococcal infections each year. Despite the effectiveness of the conjugate pneumococcal vaccines, problems with this approach remain including the expense of production and delivery, and resulting serotype replacement as demonstrated in several clinical trials and epidemiologic studies. One positive effect of the current capsular-based vaccines has been evident in the patient population that is not being vaccinated: herd immunity plays an impressive role in the current vaccine strategy. For each case of pneumococcal disease prevented in children, about three cases of pneumococcal disease are prevented in adults by herd immunity. In this context at least, prevention of pneumococcal colonization is a main goal of protein-based vaccine approaches, because blocking colonization will block disease.

Alternative pneumococcal vaccines that elicit serotype-independent immunity, and that maybe more readily available to economically emerging countries are needed urgently. New antigens that can address this need would be very attractive. Additionally, current methods to identify immunogens focus on techniques that do not fully optimize the extraction or identification of the full antigen repertoire. This is true in the case of pneumococcus as well as other pathogens. A method that can identify a new set of antigens has potential to be impactful for the development of vaccines for a wide set of pathogens, including pneumococcus.

SUMMARY OF THE INVENTION

An aspect of the present invention encompasses the discovery of novel antigens for pneumococcus that elicit antigen specific immune responses in mammals. Such novel antigens, and/or nucleic acids encoding the antigens, can be incorporated into immunogenic compositions and administered to elicit immune responses, e.g., to provide protection against pneumococcal colonization, invasive diseases, such as but not limited to, sepsis, and diseases and disorders caused by pneumococcus. Such novel antigens and/or responses to novel antigens can be detected to identify and/or characterize immune responses to pneumococcus.

In one aspect of the present invention provides immunogenic compositions (e.g., vaccines) comprising at least one isolated pneumococcal antigen selected from the pneumococcal proteins SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218, or fragments thereof.

One aspect of the present invention relates to an immunogenic composition comprising at least one isolated pneumococcal antigen or fragment thereof with the amino acid sequence selected from SEQ ID NO: 1-76 or SEQ ID NO: 153-234, and wherein the composition elicits an immune response against *Streptococcus pneumoniae* when administered to a mammal. In some embodiments, a pneumococcal antigen or fragment thereof exists as a fusion conjugate, for example, where the fusion conjugate is a polysaccharide conjugate. In some embodiments, a fusion conjugate comprises the pneumococcal antigen or fragment thereof fused to a pneumococcal pneumolysoid PdT, wherein the pneumococcal pneumolysoid PdT is conjugated to the polysaccharide. In some embodiments, the fusion conjugate comprises a polysaccharide which is dextran, Vi polysaccharide of *Salmonella typhi*, or pneumococcal cell wall polysaccharide (CWPS), or another polysaccharide of prokaryotic or eukaryotic origin.

In some embodiments of all aspects of the invention, an immunogenic composition induces a IL-17A (Th17-cell) response in a subject. In some embodiments, an immunogenic composition induces an immune response which comprises a humoral immune response and/or cellular immune response.

In some embodiments, an immunogenic composition is further prepared as a vaccine that reduces or protects a mammal against pneumococcal colonization. In some embodiments, an immunogenic composition further comprises an adjuvant. In some embodiments, an immunogenic composition as disclosed herein is administered mucosally.

In some embodiments of all aspects of the invention, an immunogenic composition comprises at least 3, or at least 5, or between 5-20 pneumococcal antigens or fragments or more than 20 with the amino acid sequence selected from SEQ ID NO: 1-76 or SEQ ID NO: 153-234.

In some embodiments of all aspects of the invention, an immunogenic composition comprises at least one of the pneumococcal proteins SP0785, SP1500 and SP2145.

Another aspect of the present invention relates to a method of inducing an IL-17A response in a subject, comprising administering to the subject at least one immunogenic composition as disclosed herein, e.g., a pneumococcus antigen of Table 1, or a functional fragment thereof effective to induce an immune response against *Streptococcus pneumoniae* in the subject.

Another aspect of the present invention relates to a method to protect against pneumococcus colonization, comprising administering to the subject at least one immunogenic composition as disclosed herein, e.g., a pneumococcal antigen of Table 1, or a functional fragment thereof.

Another aspect of the present invention relates to a method to elicit an immune response against *Streptococcus pneumoniae* in a mammal, the method comprising administering to the mammal at least one immunogenic composition comprising one or more isolated pneumococcal antigen or fragment thereof as disclosed herein in Table 1, with the amino acid sequence selected from SEQ ID NO: 1-76 or SEQ ID NO: 153-234 in an effective to induce an immune response against *Streptococcus pneumoniae* in the subject.

Another aspect of the present invention relates to a method to protect against *Salmonella typhi* colonization in a mammal, comprising administering to the mammal at least one immunogenic composition as disclosed herein, e.g., a pneumococcus antigen of Table 1, or a functional fragment thereof effective to induce an immune response against *Streptococcus pneumoniae* in the subject.

In all embodiments of the aspects described herein, an immunogenic composition can comprise at least one isolated pneumococcus antigen or fragment thereof selected from SP0785 or SP1500, and/or has an amino acid sequence substantially identical to SEQ ID NO: 34 (SP0785) or SEQ ID NO: 51 (SP1500) or a functional fragment thereof.

Another aspect of the present invention relates to a method to protect against an invasive disease of *Streptococcus pneumoniae* in a subject, comprising administering to the subject an immunogenic composition as disclosed herein, e.g., a pneumococcus antigen of Table 1, or a functional fragment thereof in effective to induce an immune response against *Streptococcus pneumoniae* in the subject. In some embodiments, such an invasive disease is, for example, sepsis. In such an embodiment, the method comprises an immunogenic composition comprising at least one isolated pneumococcus antigen or fragment thereof is SP1386, SP1500, SP0084 and SP1479 and SP0346, and/or at least one pneumococcal antigen that has an amino acid sequence substantially identical to SEQ ID NO: 46 (SP1386), SEQ ID NO: 51 (SP1500), SEQ ID NO: 4 (SP0084), SEQ ID NO: 50 (SP1479) and SEQ ID NO: 15 (SP0346) or a functional fragment thereof.

In all embodiments of the aspects described herein, an immunogenic composition can be administered by mucosal administration, or any other applicable route, for example but not limited to, intravenous, subcutaneous or intraperitoneal (IP) administration.

In some embodiments, an immunogenic composition comprises at least one isolated pneumococcus antigen selected from any one or a combination of the pneumococcus antigens with the amino acid sequences 1-76 or SEQ ID NO: 153-234. In some embodiments, the pneumococcus antigens are the full length pneumococcus proteins of SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218. In some embodiments, a pneumococcus antigen comprises a pneumococcus protein that lacks a signal sequence and/or transmembrane domain. In some embodiments, a pneumococcus antigen comprises a mixture of a full length pneumococcus proteins and fragments resulting from processing, or partial processing of a signal sequence by an expression host, e.g., *E. coli* or an insect cell line (e.g., the baculovirus expression system), or a mammalian (e.g., human or Chinese hamster Ovary (CHO)) cell line. As used herein, the terms "portion" and "fragment" or grammatical equivalents are used interchangeably.

In some embodiments, the pneumococcal antigens are fragments of the full length pneumococcal proteins of SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218, for example, at least 7, 8, 9, 10, 11, 12, 13, 14, 15, 16, 17, 18, 19, 20, 25, 30, 35, 40, 45, 50, 55, 60, 65, 70, 75, 80, 85, 90, 100, 150, 200, 250, 300, 350 or 400 consecutive amino acids of such proteins.

In some embodiments, a pneumococcal antigen comprises an amino acid sequence which is at least 60% (e.g., at least 60%, at least 65%, at least 70%, at least 75%, at least 80%, at least 85%, at least 90%, at least 95%, at least 98% or at least 99%) identical to at 7, 8, 9, 10, 11, 12, 13, 14, 15, 16, 17, 18, 19, 20, 25, 30, 35, 40, 45, 50, 55, 60, 65, 70, 75, 80, 85, 90, 100, 150, 200, 250, 300, 350 or 400 consecutive amino acids of the pneumococcal proteins of SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218.

Accordingly, the inventors herein have identified pneumococcal T-cell immunogens that both induce an IL-17A (e.g. a Th17-cell) response and protect mice from colonization. These proteins, including SP0785, SP1500, SP2145, or fragments thereof, show promise as vaccine candidates against colonization and sepsis. In some embodiments, a novel pneumococcal immunogens as disclosed herein e.g., as disclosed in Table 1, are administered by mucosal immunization, and can be optionally administered with an adjuvant, to reduce subsequent pneumococcal nasal colonization.

In some embodiments, an immunogenic composition comprises a SP1386, SP1500, SP0084, SP1479 and SP0346, or fragments thereof in a method to prevent or treat sepsis in a subject, such as a mammalian subject, including a human subject.

In some embodiments, an immunogenic composition comprising at least one isolated pneumococcal antigen is prepared as a vaccine that reduces or protects a mammal against pneumococcal colonization. In some embodiments, such an immunogenic composition can further comprise at least one adjuvant, e.g., selected from the group comprising, but not limited to cholera toxin, CFA, IFA, alum and others commonly known in the art and disclosed herein.

Another aspect of the present invention relates to pharmaceutical composition for eliciting an immune response in a mammal comprising the T-cell stimulating immunogens prepared according to the methods as disclosed herein. In such embodiments, a pharmaceutical composition can further comprise an adjuvant and/or a vaccine scaffold. In some embodiments, a pharmaceutical composition can further comprise an adjuvant.

In some embodiments, the immunogenic composition as disclosed herein can be administered to a subject mucosally. In all aspects of all embodiments as described herein, a subject is a mammalian subject, e.g., a human, however other subjects are contemplated such as domestic and agricultural animals and the like.

The invention also provides compositions including nucleic acids encoding a pneumococcal antigen as described herein. In some embodiments, a composition includes an isolated nucleic acid comprising a nucleotide sequence encoding a pneumococcal antigen selected from Table 1, or combinations thereof, and further comprises a pharmaceutically acceptable excipient. In some embodiments, a composition further comprises an adjuvant.

In another aspect, the invention provides methods for eliciting an immune response against pneumococcus in a mammal based on nucleic acids described herein in Table 1. In some embodiments, the invention provides methods for eliciting an immune response against pneumococcus in a mammal by administering to the mammal a composition comprising a nucleic acid, wherein the nucleic acid comprises a nucleotide sequence encoding a pneumococcal antigen as disclosed in Table 1 or combinations thereof.

In another aspect, the invention provides methods for characterizing and/or detecting an immune response to a pneumococcal antigen in a subject (e.g., a pneumococcal polypeptide antigen selected from Table 1 or combinations thereof). In some embodiments, an immune response in a naive subject is characterized. In some embodiments, an immune response in a subject infected, or suspected of having been infected, with pneumococcus is characterized. In some embodiments, an immune response in a subject administered an immunogenic composition comprising a pneumococcal antigen (e.g., an immunogenic composition described herein) is characterized. In some embodiments, an antibody response is characterized. In some embodiments, a B cell response is characterized. In some embodiments, a T cell response is characterized. In some embodiments, IFN-γ secretion by antigen-specific T cells is characterized. In some embodiments, a Th1 T cell response is characterized. In some embodiments, a Th17 T cell response is characterized, and in some embodiments, IL-17A secretion is characterized. In some embodiments, a cytotoxic T cell response is characterized. In some embodiments, both a T cell and a B cell response are characterized. In some embodiments, an innate immune response is characterized.

The invention further provides methods of preparing compositions including pneumococcual antigens, and antibodies that specifically bind to pneumococcal antigens as disclosed in Table 1.

Compositions and methods described herein can be used for the prophylaxis and/or treatment of any pneumococcus disease, disorder, and/or condition due to a pneumococcual infection. In some embodiments, an immunogenic composition described herein reduces risk of infection by, and/or treats, alleviates, ameliorates, relieves, delays onset of, inhibits progression of, reduces severity of, and/or reduces incidence of one or more symptoms or features of a pneumococcal disease, disorder, and/or condition. In some embodiments, the prophylaxis and/or treatment of pneumococcal infection comprises administering a therapeutically effective amount of an immunogenic composition comprising a novel pneumococcal antigen described herein to a subject in need thereof, in such amounts and for such time as is necessary to achieve the desired result. In certain embodiments of the present invention a "therapeutically effective amount" of an inventive immunogenic composition is that amount effective for treating, alleviating, ameliorating, relieving, delaying onset of, inhibiting progression of, reducing severity of, and/or reducing incidence of one or more symptoms or features of pneumococcal infection.

In some embodiments, inventive prophylactic, prognostic and/or therapeutic protocols involve administering a therapeutically effective amount of one or more immunogenic compositions comprising a novel pneumococcal antigen to a subject such that an immune response is stimulated in one or both of T cells and B cells. The present invention also provides novel immunogenic compositions comprising a therapeutically effective amount of one or more pneumococcal antigens (e.g., one or more of a polypeptide antigen selected from Table 1 or combinations thereof) and one or more pharmaceutically acceptable excipients. In some embodiments, the present invention provides for pharmaceutical compositions comprising an immunogenic composition as described herein. In accordance with some embodiments, a method of administering a pharmaceutical composition comprising inventive compositions to a subject (e.g. human, e.g., a child, adolescent, or young adult) in need thereof is provided.

In some embodiments, a therapeutically effective amount of an immunogenic composition is delivered to a patient and/or animal prior to, simultaneously with, and/or after diagnosis with a pneumococcal disease, disorder, and/or condition. In some embodiments, a therapeutic amount of an inventive immunogenic composition is delivered to a patient and/or animal prior to, simultaneously with, and/or after onset of symptoms of a pneumococcal disease, disorder, and/or condition.

In some embodiments, immunogenic compositions of the present invention are administered by any of a variety of routes, including oral, intramuscular, subcutaneous, transdermal, intradermal, rectal, intravaginal, mucosal, nasal, buccal, enteral, sublingual; by intratracheal instillation, bronchial instillation, and/or inhalation; and/or as an oral spray, nasal spray, and/or aerosol. In some embodiments, immunogenic compositions of the present invention are administered by a variety of routes, including intravenous, intra-arterial, intramedullary, intrathecal, intraventricular, transdermal, intraperitoneal, topical (as by powders, ointments, creams, and/or drops), transdermal, or by intratracheal instillation.

In certain embodiments, an immunogenic composition may be administered in combination with one or more additional therapeutic agents which treat the symptoms of pneumococcal infection (e.g., with an antibiotic such as a beta-lactam antibiotic, an erythromycin, or a tetracycline).

Another aspect of the present invention relates to the use of the immunogenic composition as disclosed herein to be administered to a subject to elicit an immune response in the subject. In some embodiments, the immune response is an antibody/B cell response, a CD4+ T cell response (including Th1, Th2 and Th17 cells) and/or a CD8+ T-cell response. In some embodiments, at least one adjuvant is administered in conjunction with the immunogenic composition.

Another aspect of the present invention relates to a method for inducing an immune response in a subject to at least one antigen, comprising administering to the subject the immunogenic composition as disclosed herein.

Another aspect of the present invention relates to a method of vaccinating an animal, e.g., a bird, a mammal or a human, against at least one antigen comprising administering a vaccine composition comprising the immunogenic composition as disclosed herein.

In all aspects as disclosed herein, an animal or a subject can be a human. In some embodiments, the subject can be an agricultural or non-domestic animal, or a domestic animal. In some embodiments, a vaccine composition comprising the immunogenic composition as disclosed herein can be administered via subcutaneous, intranasal, oral, sublingual, vaginal, rectal, intradermal, intraperitoneal, intra muscular injection, or via skin-patch for transcutaneous immunization.

In all aspects as disclosed herein, an immune response is an antibody/B cell response, a CD4+ T cell response (including Th1, Th2 and Th17 responses) or a CD8+ T-cell response against protein/peptide antigen(s). In some embodiments, an immune response is an antibody/B cell response against the polymer, e.g., a pneumococcal polysaccharide. In some embodiments, at least one adjuvant is administered in conjunction with the immunogenic composition.

Another aspect of the present invention relates to the use of the immunogenic composition as disclosed herein for use in a diagnostic for exposure to a pathogen or immunogenic agent.

Another aspect of the present invention relates to kits for preparing an immunogenic composition as disclosed herein. For example, such kits can comprise any one or more of the following materials: a container comprising a polymer, e.g., a polysaccharide, cross-linked with a plurality of first affinity molecules; and a container comprising a complementary affinity molecule which associates with the first affinity molecule, wherein the complementary affinity molecule associates with an antigen.

The invention provides a variety of kits comprising one or more of the immunogenic compositions of the invention. For example, the invention provides a kit comprising an immunogenic composition comprising a pneumococcual antigen, or a nucleic acid encoding the antigen, wherein the antigen is selected from Table 1 or functional fragments or combinations thereof; and instructions for use. A kit may comprise multiple different pneumococcal antigens. A kit may comprise any of a number of additional components or reagents in any combination. According to certain embodiments of the invention, a kit may include, for example, (i) a pneumococcal polypeptide antigen selected from Table 1 or combinations thereof; (ii) an adjuvant; and (iii) instructions for administering a composition including the pneumococcal antigen and the adjuvant to a subject in need thereof.

In some embodiments, the kit can comprise a container comprising an expression vector for expressing a pneumococcal polypeptide antigen selected from Table 1, for example. In some embodiments, the vector can optionally comprise a sequence for a linker peptide, wherein the expression vector can expresses a pneumococcal polypeptide antigen selected from Table 1.

Provided herein also is a method of vaccinating a subject, e.g., a mammal, e.g., a human with the immunogenic compositions as disclosed herein, the method comprising administering a vaccine composition as disclosed herein to the subject.

BRIEF DESCRIPTION OF THE DRAWINGS

FIGS. 1A-1B show that pneumococcus antigens provide protection against colonization. FIG. 1A shows decreased colony forming units (CFU) in a nasal wash of mice challenged with serotype 6B pneumococcal strain after twice weekly immunization with SP0785 in the presence of the adjuvant cholera toxin (CT) as compared to CT alone. FIG. 1B shows decreased colony forming units (CFU) in a nasal wash of mice challenged with serotype 6B pneumococcal strain after twice weekly immunization with SP1500 in the presence of the adjuvant cholera toxin (CT) as compared to CT alone.

FIG. 2 is a survival curve of mice with sepsis showing that immunization with a fusion protein consisting of SP0785-PdT protected 80% mice against sepsis, and fusion protein SP2145-PdT protected 90% of mice against sepsis as compared to mice immunized with control mice (Alum only) or PdT alone (which protected only 30% of mice).

FIGS. 3A-3B show pneumococcal antigens fused to PdT (pneumococcal pneumolysoid PdT) and covalently conjugated to the Vi polysaccharide generates IL-17A and anti-Vi antibody; protecting against sepsis challenge and preventing invasive infection and nasopharyngeal colonization of pneumococcus. FIG. 3A shows high levels of IL-17A when stimulated with whole cell vaccine (WCV) after the mice were immunized with SP0785-PdT-Vi conjugate or SP2145-PdT-Vi conjugate as compared to the control Alum alone. FIG. 3B shows high levels of anti-Vi IgG in mice were immunized with SP0785-PdT-Vi conjugate or SP2145-PdT-Vi conjugate, as compared to Alum alone.

FIG. 4 is a survival curve of mice with sepsis showing that immunization with a fusion protein consisting of SP2145-PdT-Vi or SP0785-PdT-Vi protected 80% mice against sepsis as compared to mice immunized with control mice (Alum only) (which protected only 20% of mice).

FIG. 5 shows results from a flow cytometric assay showing that antibodies present in the serum from mice immunized with SP0785 (black) can label the encapsulated pneumococcal strain Tigr4 as compared to serum obtained from mice immunized with alum alone (grey). Thus, FIG. 5 demonstrates that anti-SP0785 antibody is able to bind to encapsulated pneumococcal strain.

DETAILED DESCRIPTION OF THE INVENTION

Figure 2:
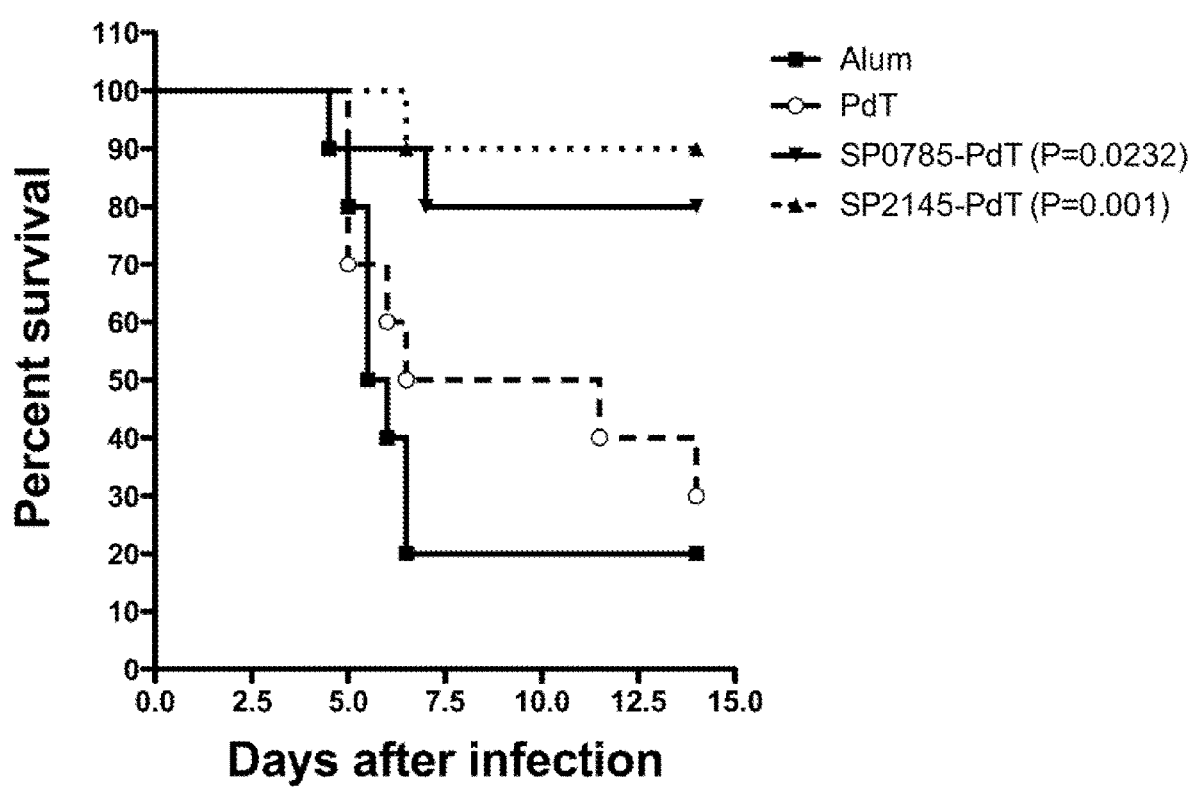
FIG. 2 shows pneumococcus antigens fused to Pdt (pneumococcal pneumolysoid PdT) protects against sepsis challenge and prevents against invasive infection and nasopharyngeal colonization of pneumococcus.

*Streptococcus pneumoniae* (*S. pneumoniae*) is a common cause of bacterial pneumonia, meningitis, otitis media, and bacteremia in children, the elderly, and immunodeficient individuals. *S. pneumoniae* can be subdivided into approximately 90 serotypes, based on the capsular polysaccharide of the organism. However, disease is generally caused by approximately 30 types of *S. pneumoniae* isolates. The World Health Organization estimates that there are one million deaths among children due to pneumococcal meningitis and sepsis each year, with 98% of these deaths occurring in developing countries. The emergence of pneumococcal strains with antimicrobial resistance underscores the need for treating and preventing pneumococcal infection by methods in addition to antimicrobials.

One aspect of the present invention encompasses the discovery of novel antigens for pneumococcus that elicit antigen specific immune responses in mammals. Such novel antigens, and/or nucleic acids encoding the antigens, can be incorporated into immunogenic compositions and administered to elicit immune responses, e.g., to provide protection against pneumococcal colonization, invasive diseases, such as but not limited to, sepsis, and diseases and disorders caused by pneumococcus organisms. Such novel antigens and/or responses to novel antigens can be detected to identify and/or characterize immune responses to pneumococcal organisms.

Another aspect of the present invention provides immunogenic compositions (e.g., vaccines) comprising at least one isolated pneumococcus antigen selected from the pneumococcus proteins listed in Table 1, e.g., SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218, or functional fragments thereof, such as those shown in SEQ ID NO: 153-234. In some embodiments, an immunogenic composition comprising at least one isolated pneumococcus antigen selected from the pneumococcus proteins of SP0785, SP1500, SP0346, SP1386, SP0084, SP1479 and SP2145 which protect against pneumococcus and pneumococcal infection, such as sepsis.

It should be understood that this invention is not limited to the particular methodology, protocols, and reagents, etc., described herein and as such may vary. The terminology used herein is for the purpose of describing particular embodiments only, and is not intended to limit the scope of the present invention, which is defined solely by the claims.

Definitions

The term "antigen" as used herein refers to a molecule (e.g., a polypeptide) that elicits a specific immune response. Antigen specific immunological responses, also known as adaptive immune responses, are mediated by lymphocytes (e.g., T cells, B cells) that express antigen receptors (e.g., T cell receptors, B cell receptors). In certain embodiments, an antigen is a T cell antigen, and elicits a cellular immune response. In certain embodiments, an antigen is a B cell antigen, and elicits a humoral (i.e., antibody) response. In certain embodiments, an antigen is both a T cell antigen and a B cell antigen. As used herein, the term "antigen" encompasses both a full-length polypeptide as well as a portion of the polypeptide, that represent immunogenic fragments (i.e., fragments that elicit an antigen specific T cell response, B cell response, or both) of such complete polypeptides. In some embodiments, antigen is a peptide epitope found within a polypeptide sequence (e.g., a peptide epitope bound by a Major Histocompatibility Complex (MHC) molecule (e.g., MHC class I, or MHC class II). Accordingly, peptides 5-15 amino acids in length, and longer polypeptides, e.g., having 60, 70, 75, 80, 85, 90, 100, 150, 200 250, or more amino acids, can be "antigens". In an exemplary example, the present invention provides a SP0785 polypeptide antigen. In some embodiments, a SP0785 polypeptide antigen includes a full-length SP0785 polypeptide amino acid sequence (e.g., a full-length SP0785 polypeptide of SEQ ID NO:34). In some embodiments, a SP0785 polypeptide antigen includes a portion of a SP0785 polypeptide (e.g., a portion of the SP0785 polypeptide of SEQ ID NO:34, which portion includes at least 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250, 300, 350, or 400 contiguous amino acids of SEQ ID NO:34). In some embodiments, a portion of a SP0785 polypeptide corresponds to a protein having the amino acid sequence of SEQ ID NO: 190. In some embodiments, a SP0785 polypeptide antigen contains one or more amino acid alterations (e.g., deletion, substitution, and/or insertion) from a naturally-occurring wild-type SP0785 polypeptide sequence. For example, a SP0785 polypeptide antigen may contain an amino acid sequence that is at least 60% (e.g., at least 65%, 70%, 75%, 80%, 85%, 90%, 95%, or 98%) identical to SEQ ID NO:34 or a portion thereof (e.g., at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:34). Alternatively, a SP0785 polypeptide antigen may contain a portion (e.g., at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids) of a sequence that is at least 60% (e.g., at least 65%, 70%, 75%, 80%, 85%, 90%, 95%, or 98%) identical to SEQ ID NO:34 or SEQ ID NO: 190. SP0785 polypeptide antigen is used as an example. This concept is applicable to other polypeptide antigen described herein including, but not limited to, SP1500, SP0346, SP1386, SP0084, SP1479, and SP2145 polypeptide antigens, and any of those polypeptide antigens listed in Table 1.

The term "pneumococcal antigen" refers to an antigen that elicits an antigen specific immune response against any organism of the pneumococcal genus, such as a *Streptococcus pneumonia* organism, etc. In some embodiments, a pneumococcal antigen elicits an antigen specific immune response against *S. pneumonia* organisms of multiple species. Pneumococcal antigens include full-length polypeptides encoded by pneumococcal genes shown in Table 1 (SEQ ID NO: 1-76), as well as immunogenic portions of the polypeptides shown in Table 2 (SEQ ID NOs: 153-234).

The term "immunogenic composition" as used herein refers to a composition that is capable of eliciting an immune response, such as an antibody or cellular immune response, when administered to a subject. In some embodiments, an immunogenic composition includes a polypeptide or peptide antigen. The immunogenic compositions of the present invention may or may not be immunoprotective or therapeutic. When the immunogenic compositions of the present invention prevent, ameliorate, palliate or eliminate disease from the subject, then the immunogenic composition may optionally be referred to as a vaccine. As used herein, however, the term immunogenic composition is not intended to be limited to vaccines. In some embodiments, an immunogenic composition includes a nucleic acid encoding a polypeptide or peptide antigen. An immunogenic composition can include molecules that induce an immune response against multiple antigens.

The term "antibody" as used herein refers to any immunoglobulin, whether natural or wholly or partially synthetically produced. All derivatives thereof that maintain specific binding ability are also included in the term. The term also covers any protein having a binding domain which is homologous or largely homologous to an immunoglobulin-binding domain. Such proteins may be derived from natural sources, or partly or wholly synthetically produced. An antibody may be monoclonal or polyclonal. An antibody may be a member of any immunoglobulin class, including any of the human classes: IgG, IgM, IgA, IgD, and IgE. As used herein, the terms "antibody fragment" or "characteristic portion of an antibody" are used interchangeably and refer to any derivative of an antibody which is less than full-length. In general, an antibody fragment retains at least a significant portion of the full-length antibody's specific binding ability. Examples of antibody fragments include, but are not limited to, Fab, Fab', F(ab')2, scFv, Fv, dsFv diabody, and Fd fragments. An antibody fragment may be produced by any means. For example, an antibody fragment may be enzymatically or chemically produced by fragmentation of an intact antibody and/or it may be recombinantly produced from a gene encoding the partial antibody sequence. Alternatively or additionally, an antibody fragment may be wholly or partially synthetically produced. An antibody fragment may optionally comprise a single chain antibody fragment. Alternatively or additionally, an antibody fragment may comprise multiple chains which are linked together, for example, by disulfide linkages. An antibody fragment may optionally comprise a multimolecular complex. A functional antibody fragment will typically comprise at least about 50 amino acids and more typically will comprise at least about 200 amino acids.

The terms "Cytotoxic T Lymphocyte" or "CTL" refers to lymphocytes which induce death via apoptosis or other mechanisms in targeted cells. CTLs form antigen-specific conjugates with target cells via interaction of TCRs with processed antigen (Ag) on target cell surfaces, resulting in apoptosis of the targeted cell. Apoptotic bodies are eliminated by macrophages. The term "CTL response" is used to refer to the primary immune response mediated by CTL cells.

The term "cell mediated immunity" or "CMI" as used herein refers to an immune response that does not involve antibodies or complement but rather involves the activation of, for example, macrophages, natural killer cells (NK), antigen-specific cytotoxic T-lymphocytes (T-cells), T-helper cells, neutrophils, and the release of various cytokines in response to a target antigen. Stated another way, CMI refers to immune cells (such as T cells and other lymphocytes) which bind to the surface of other cells that display a target antigen (such as antigen presenting cells (APC)) and trigger a response. The response may involve either other lymphocytes and/or any of the other white blood cells (leukocytes) and the release of cytokines. Cellular immunity protects the body by: (i) activating antigen-specific cytotoxic T-lymphocytes (CTLs) that are able to destroy body cells displaying epitopes of foreign antigen on their surface, such as virus-infected cells and cells with intracellular bacteria; (2) activating macrophages and NK cells, enabling them to destroy intracellular pathogens; and (3) stimulating cells to secrete a variety of cytokines or chemokines that influence the function of other cells such as T cells, macrophages or neutrophils involved in adaptive immune responses and innate immune responses.

The term "immune cell" as used herein refers to any cell which can release a cytokine, chemokine or antibody in response to a direct or indirect antigenic stimulation. Included in the term "immune cells" herein are lymphocytes, including natural killer (NK) cells, T-cells (CD4+ and/or CD8+ cells), B-cells, macrophages; leukocytes; dendritic cells; mast cells; monocytes; and any other cell which is capable of producing a cytokine or chemokine molecule in response to direct or indirect antigen stimulation. Typically, an immune cell is a lymphocyte, for example a T-cell lymphocyte.

The term "cytokine" as used herein refers to a molecule released from an immune cell in response to stimulation with an antigen. Examples of such cytokines include, but are not limited to: GM-CSF; IL-1α; IL-1β; IL-2; IL-3; IL-4; IL-5; IL-6; IL-7; IL-8; IL-10; IL-12; IL-17A, IL-17F or other members of the IL-17 family, IL-22, IL-23, IFN-γ; IFN-β; IFN-α; MIP-1α; MIP-1β; TGF-α; TNFα☐ or TNFβ. The term "cytokine" does not include antibodies The term "in vitro" as used herein refers to events that occur in an artificial environment, e.g., in a test tube or reaction vessel, in cell culture, etc., rather than within an organism (e.g., animal, plant, and/or microbe).

As used herein, the term "in vivo" refers to events that occur within an organism (e.g., animal, plant, and/or microbe).

The term "isolated" as used herein, means that the isolated entity has been separated from at least one component with which it was previously associated. When most other components have been removed, the isolated entity is "purified." Isolation and/or purification and/or concentration may be performed using any techniques known in the art including, for example, chromatography, fractionation, precipitation, or other separation.

The term "adjuvant" as used herein refers to any agent or entity which increases the antigenic response (e.g., immune response) by a cell or a subject to a target antigen. In some embodiments, an adjuvant is used to enhance an immune response to a peptide antigen administered to a subject. In some embodiments, an adjuvant is used to enhance an immune response to an antigen encoded by a nucleic acid administered to a subject.

As used herein, the term "pathogen" refers to an organism or molecule that causes a disease or disorder in a subject. For example, pathogens include but are not limited to viruses, fungi, bacteria, parasites and other infectious organisms or molecules therefrom, as well as taxonomically related macroscopic organisms within the categories algae, fungi, yeast and protozoa or the like.

As used herein, the term "prokaryotic pathogen" refers to a bacterial pathogen.

As used herein, the term "viral pathogen" refers to a virus that causes illness or disease, such as HIV.

As used herein, the term "parasitic pathogen" refers to a microorganism that is parasitic, residing for an extended period inside a host cell or host organism that gains benefits from the host and at the same time causes illness or disease. A parasitic pathogen can be bacteria, viruses, fungi, and parasites, and protists.

The term "functional fragment" or "portion" as used in the context of a functional fragment of an immunogen of protein "x" (e.g., an pneumococcal antigen or immunogen listed Table 1) refers to a fragment of such a protein or peptide that mediates, effects or elicits a cellular and/or humoral immune response as similar to the protein or peptide from which it was derived (e.g. a fragment thereof). Accordingly, the term "functional" when used in conjunction with "derivative" or "variant" or "fragment" refers to a polypeptide which possess a biological activity that is substantially similar to a biological activity of the entity or molecule of which it is a derivative or variant or fragment thereof. By "substantially similar" in this context is meant that at least 25%, at least 35%, at least 50% of the relevant or desired biological activity of a corresponding wild-type peptide is retained. In the instance of a fragment of a pneumococcal antigen, such as for example, SP0785 (e.g., SEQ ID NO: 34), a functional fragment of SEQ ID NO: 34 or SEQ ID NO: 190 would be a protein or peptide comprising a portion of SEQ ID NO: 34 or SEQ ID NO: 190 which retained an activity for eliciting an IL-17A response in splenocytes or human PMBC, and protect against colonization by pneumococcal organism; preferably the fragment of SEQ ID NO: 34 or SEQ ID NO: 190 retains at least 25%, at least 35%, at least 50% at least 60%, at least 70%, at least 80%, at least 90%, at least 95%, at least 100% or even higher (i.e., the variant or derivative has greater activity than the wild-type), e.g., at least 110%, at least 120%, or more activity as compared to the full length SEQ ID NO: 34 or SEQ ID NO: 190 to elicit an IL-17A response in splenocytes or human PMBC and protect against colonization by pneumococcus. Such functional fragments of the immunogens (e.g. antigens) listed in Table 1 can be assessed by the assays as disclosed in the Examples, e.g., to assess if a functional fragment elicits an IL-17A response in mouse splenocytes or human PBMCs in vitro as disclosed in Example 2, or protects colonization in vivo in a mouse colonization model, where mice are challenged with a serotype of pneumococcal strain (e.g., serotypes 6B, 14F or 19F) after biweekly immunization with a pneumococcal antigen (or functional fragment), and assessing for presence of pneumococcal colonization in the nasopharynx, as disclosed in Example 3.

A "fragment" of an antigen or immunogen of Table 1 as that term is used herein will be at least 15 amino acids in length, and can be, for example, at least 16, at least 17, at least 18, at least 19, at least 20 or at least 25 amino acids or greater inclusive.

The term "Cytotoxic T Lymphocyte" or "CTL" refers to lymphocytes which induce apoptosis in targeted cells. CTLs form antigen-specific conjugates with target cells via interaction of TCRs with processed antigen (Ag) on target cell surfaces, resulting in apoptosis of the targeted cell. Apoptotic bodies are eliminated by macrophages. The term "CTL response" is used to refer to the primary immune response mediated by CTL cells.

The term "cell mediated immunity" or "CMI" as used herein refers to an immune response that does not involve antibodies or complement but rather involves the activation of macrophages, natural killer cells (NK), antigen-specific cytotoxic T-lymphocytes (T-cells), and the release of various cytokines in response to a target antigen. Stated another way, CMI refers to immune cells (such as T cells and lymphocytes) which bind to the surface of other cells that display the antigen (such as antigen presenting cells (APS)) and trigger a response. The response can involve either other lymphocytes and/or any of the other white blood cells (leukocytes) and the release of cytokines. Accordingly, cell-mediated immunity (CMI) is an immune response that does not involve antibodies but rather involves the activation of macrophages and NK-cells, the production of antigen-specific cytotoxic T-lymphocytes, and the release of various cytokines in response to an antigen. Cellular immunity protects the body by: (i) activating antigen-specific cytotoxic T-lymphocytes (CTLs) that are able to destroy body cells displaying epitopes of foreign antigen on their surface, such as virus-infected cells, cells with intracellular bacteria, and cancer cells displaying tumor antigens; (2) activating macrophages and NK cells, enabling them to destroy intracellular pathogens; and (3) stimulating cells to secrete a variety of cytokines that influence the function of other cells involved in adaptive immune responses and innate immune responses. Without wishing to be bound by theory and by way of background, the immune system was separated into two branches: humoral immunity, for which the protective function of immunization could be found in the humor (cell-free bodily fluid or serum) and cellular immunity, for which the protective function of immunization was associated with cells.

The term "immune cell" as used herein refers to any cell which can release a cytokine in response to a direct or indirect antigenic stimulation. Included in the term "immune cells" herein are lymphocytes, including natural killer (NK) cells, T-cells (CD4+ and/or CD8+ cells), B-cells, macrophages and monocytes, Th cells; Th1 cells; Th2 cells; Tc cells; stromal cells; endothelial cells; leukocytes; dendritic cells; macrophages; mast cells and monocytes and any other cell which is capable of producing a cytokine molecule in response to direct or indirect antigen stimulation. Typically, an immune cell is a lymphocyte, for example a T-cell lymphocyte.

The term "nucleic acid" as used herein, in its broadest sense, refers to any compound and/or substance that is or can be incorporated into an oligonucleotide chain. In some embodiments, a nucleic acid is a compound and/or substance that is or can be incorporated into an oligonucleotide chain via a phosphodiester linkage. As used herein, the terms "oligonucleotide" and "polynucleotide" can be used interchangeably. In some embodiments, "nucleic acid" encompasses RNA as well as single and/or double-stranded DNA and/or cDNA. Furthermore, the terms "nucleic acid," "DNA," "RNA," and/or similar terms include nucleic acid analogs, i.e. analogs having other than a phosphodiester backbone. The term "nucleotide sequence encoding an amino acid sequence" includes all nucleotide sequences that are degenerate versions of each other and/or encode the same amino acid sequence. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, backbone modifications, etc. A nucleic acid sequence is presented in the 5' to 3' direction unless otherwise indicated.

The term "polypeptide", as used herein, generally has its art-recognized meaning of a polymer of at least three amino acids. However, the term is also used to refer to specific classes of antigen polypeptides, such as, for example, SP0785 polypeptides, SP1500 polypeptides, SP0346 polypeptides, SP1386 polypeptides, SP0084 polypeptides, SP1479 polypeptides and SP2145 polypeptides. For each such class, the present specification provides several examples of known sequences of such polypeptides. Those of ordinary skill in the art will appreciate, however, that the term "polypeptide", as used herein to refer to "polypeptide antigen", is intended to be sufficiently general as to encompass not only polypeptides having a sequence recited herein, but also to encompass polypeptides having a variation of the sequence that elicits an antigen-specific response to the polypeptide. For example, a "SP0785 polypeptide" includes the SP0785 polypeptide shown in SEQ ID NO:34, as well as polypeptides that have variations of a SEQ ID NO:34 sequence, such as for example, a fragment of SP0785 as shown in SEQ ID NO: 190, and that maintain the ability to elicit an antigen-specific response to a polypeptide of SEQ ID NO:34. Those of ordinary skill in the art understand that protein sequences generally tolerate some substitution without destroying immunogenicity and antigen specificity. Thus, any polypeptide that retains immunogenicity and shares at least about 30-40% overall sequence identity, often greater than about 50%, 60%, 70%, or 80%, and further usually including at least one region of much higher identity, often greater than 90% or even 95%, 96%, 97%, 98%, or 99% in one or more highly conserved regions, usually encompassing at least 3-4 and often up to 20 or more amino acids, with another polypeptide of the same class, is encompassed within the relevant term "polypeptide" as used herein. Other regions of similarity and/or identity can be determined by those of ordinary skill in the art by analysis of the sequences of various polypeptides presented herein. See the definition of Antigen. It will be appreciated that proteins or polypeptides often contain amino acids other than the 20 amino acids commonly referred to as the 20 naturally occurring amino acids, and that many amino acids, including the terminal amino acids, can be modified in a given polypeptide, either by natural processes such as glycosylation and other post-translational modifications, or by chemical modification techniques which are well known in the art. Known modifications which can be present in polypeptides of the present invention include, but are not limited to, acetylation, acylation, ADP-ribosylation, amidation, covalent attachment of flavin, covalent attachment of a heme moiety, covalent attachment of a polynucleotide or polynucleotide derivative, covalent attachment of a lipid or lipid derivative, covalent attachment of phosphotidylinositol, cross-linking, cyclization, disulfide bond formation, demethylation, formation of covalent cross-links, formation of cystine, formation of pyroglutamate, formulation, gamma-carboxylation, glycation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

One example of an algorithm that is suitable for determining percent sequence identity and sequence similarity is the BLAST algorithm, which is described in Altschul et al., Nuc. Acids Res. 25:3389-3402, 1977. BLAST is used, with the parameters described herein, to determine percent sequence identity for the nucleic acids and proteins of the present disclosure. Software for performing BLAST analysis is publicly available through the National Center for Biotechnology Information (available at the following internet address: ncbi.nlm.nih.gov). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, Proc. Natl. Acad. Sci. USA, 89:10915 (1989)) alignments (B) of 50, expectation (E) of 10, M=5, N=−4, and a comparison of both strands.

The BLAST algorithm also performs a statistical analysis of the similarity between two sequences (see, e.g., Karlin & Altschul, Proc. Nat'l. Acad. Sci. USA, 90:5873-5787, 1993). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

The term "subject" is used interchangeably herein with "patient" or "individual" refers to any organism to which a composition of this invention may be administered, e.g., for experimental, diagnostic, and/or therapeutic purposes. Typical subjects include mammals such as mice, rats, rabbits, non-human primates, domestic animals and humans. In some embodiments, the term "subject" refers to any animal in which it is useful to elicit an immune response. The subject can be a wild, domestic, commercial or companion animal such as a bird or mammal. The subject can be a human. Although in one embodiment of the invention it is contemplated that the immunogenic compositions as disclosed herein can also be suitable for the therapeutic or preventative treatment in humans, it is also applicable to warm-blooded vertebrates, e.g., mammals, such as non-human primates, (particularly higher primates), sheep, dog, rodent (e.g., mouse or rat), guinea pig, goat, pig, cat, rabbits, cows, and non-mammals such as chickens, ducks, or turkeys. In another embodiment, the subject is a wild animal, for example a bird such as for the diagnosis of avian flu. In some embodiments, the subject is an experimental animal or animal substitute as a disease model. The subject may be a subject in need of veterinary treatment, where eliciting an immune response to an antigen is useful to prevent a disease and/or to control the spread of a disease, for example SIV, STL1, SFV, or in the case of live-stock, hoof and mouth disease, or in the case of birds Marek's disease or avian influenza, and other such diseases.

The term "recombinant" when used to describe a nucleic acid molecule, means a polynucleotide of genomic, cDNA, viral, semisynthetic, and/or synthetic origin, which, by virtue of its origin or manipulation, is not associated with all or a portion of the polynucleotide sequences with which it is associated in nature. The term recombinant as used with respect to a peptide, polypeptide, protein, or recombinant fusion protein, means a polypeptide produced by expression from a recombinant polynucleotide. The term recombinant as used with respect to a host cell means a host cell into which a recombinant polynucleotide has been introduced. Recombinant is also used herein to refer to, with reference to material (e.g., a cell, a nucleic acid, a protein, or a vector) that the material has been modified by the introduction of a heterologous material (e.g., a cell, a nucleic acid, a protein, or a vector).

The term "vectors" refers to a nucleic acid molecule capable of transporting or mediating expression of a heterologous nucleic acid to which it has been linked to a host cell; a plasmid is a species of the genus encompassed by the term "vector." The term "vector" typically refers to a nucleic acid sequence containing an origin of replication and other entities necessary for replication and/or maintenance in a host cell. Vectors capable of directing the expression of genes and/or nucleic acid sequence to which they are operatively linked are referred to herein as "expression vectors". In general, expression vectors of utility are often in the form of "plasmids" which refer to circular double stranded DNA molecules which, in their vector form are not bound to the chromosome, and typically comprise entities for stable or transient expression or the encoded DNA. Other expression vectors that can be used in the methods as disclosed herein include, but are not limited to plasmids, episomes, bacterial artificial chromosomes, yeast artificial chromosomes, bacteriophages or viral vectors, and such vectors can integrate into the host's genome or replicate autonomously in the particular cell. A vector can be a DNA or RNA vector. Other forms of expression vectors known by those skilled in the art which serve the equivalent functions can also be used, for example self replicating extrachromosomal vectors or vectors which integrates into a host genome. Preferred vectors are those capable of autonomous replication and/or expression of nucleic acids to which they are linked.

An individual who is "suffering from" a disease, disorder, and/or condition has been diagnosed with or displays one or more symptoms of the disease, disorder, and/or condition.

An individual who is "susceptible to" a disease, disorder, and/or condition has not been diagnosed with and/or may not exhibit symptoms of the disease, disorder, and/or condition. In some embodiments, a disease, disorder, and/or condition is associated with a pneumococcal infection. Without wishing to be bound to theory, S. pneumoniae is responsible for 15-50% of all episodes of community-acquired pneumonia, 30-50% of all cases of acute otitis media and a significant proportion of bacteremia and bacterial meningitis. In some embodiments, an individual who is susceptible to a pneumococcal infection may be exposed to a pneumococcus (e.g., by ingestion, inhalation, physical contact, etc.). In some embodiments, an individual who is susceptible to a pneumococcal infection may be exposed to an individual who is infected with the microbe. In some embodiments, an individual who is susceptible to a pneumococcal infection is one who is in a location where the microbe is prevalent (e.g., one who is traveling to a location where the microbe is prevalent). In some embodiments, an individual who is susceptible to a pneumococcal infection is susceptible due to young age (e.g., a child, adolescent, or young adult). In some embodiments, a subject who is susceptible is to pneumococcal infection is a subject with Job's syndrome (subject lacking Th-17 cell-mediated response) or a aggamaglobunemic subject (a subject lacking antibody-mediated response). In some embodiments, a subject who is susceptible is a subject whose immune system is compromised, such as those living with HIV, or has an auto-immune disease, or has influenza. In some embodiments, a subject who is susceptible to a pneumococcal infection is a subject who has other risk factors, such as, but not limited to smoking, injection drug use, Hepatitis C, and COPD. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

The term "therapeutically effective amount" as used herein means an amount of a therapeutic, prophylactic, and/or diagnostic agent (e.g., inventive immunogenic composition) that is sufficient, when administered to a subject suffering from or susceptible to a disease, disorder, and/or condition, to treat, alleviate, ameliorate, relieve, alleviate symptoms of, prevent, delay onset of, inhibit progression of, reduce severity of, and/or reduce incidence of the disease, disorder, and/or condition.

The term "therapeutic agent" as used herein refers to any agent that, when administered to a subject, has a therapeutic, prophylactic, and/or diagnostic effect and/or elicits a desired biological and/or pharmacological effect.

The term "treating" as used herein refers to the term "treating" refers to partially or completely alleviating, ameliorating, relieving, delaying onset of, inhibiting progression of, reducing severity of, and/or reducing incidence of one or more symptoms or features of a particular disease, disorder, and/or condition. For example, "treating" a microbial infection may refer to inhibiting survival, growth, and/or spread of the microbe. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition. In some embodiments, treatment comprises delivery of an immunogenic composition (e.g., a vaccine) to a subject.

The term "vaccine" as used herein refers to an entity comprising at least one immunogenic component (e.g., an immunogenic component which includes a peptide or protein, and/or an immunogenic component which includes a nucleic acid). In certain embodiments, a vaccine includes at least two immunogenic components. In some embodiments, a vaccine is capable of stimulating an immune response of both T cells and B cells. In some embodiments, any assay available in the art may be used to determine whether T cells and/or B cells have been stimulated. In some embodiments, T cell stimulation may be assayed by monitoring antigen-induced production of cytokines, antigen-induced proliferation of T cells, and/or antigen-induced changes in protein expression. In some embodiments, B cell stimulation may be assayed by monitoring antibody titers, antibody affinities, antibody performance in neutralization assays, class-switch recombination, affinity maturation of antigen-specific antibodies, development of memory B cells, development of long-lived plasma cells that can produce large amounts of high-affinity antibodies for extended periods of time, germinal center reactions, and/or antibody performance in neutralization assays. In some embodiments, a vaccine further includes at least one adjuvant that can help stimulate an immune response in T cells and/or B cells.

The term "pharmaceutically acceptable" refers to compounds and compositions which may be administered to mammals without undue toxicity. The term "pharmaceutically acceptable carriers" excludes tissue culture medium. Exemplary pharmaceutically acceptable salts include but are not limited to mineral acid salts such as hydrochlorides, hydrobromides, phosphates, sulfates, and the like, and the salts of organic acids such as acetates, propionates, malonates, benzoates, and the like. Pharmaceutically acceptable carriers are well known in the art.

The term "wild-type" as used herein refers to the typical or the most common form existing in nature or as it normally exists in vivo.

The term "mutant" refers to an organism or cell with any change in its genetic material, in particular a change (i.e., deletion, substitution, addition, or alteration) relative to a wild-type polynucleotide sequence or any change relative to a wild-type protein sequence. The term "variant" may be used interchangeably with "mutant". Although it is often assumed that a change in the genetic material results in a change of the function of the protein, the terms "mutant" and "variant" refer to a change in the sequence of a wild-type protein regardless of whether that change alters the function of the protein (e.g., increases, decreases, imparts a new function), or whether that change has no effect on the function of the protein (e.g., the mutation or variation is silent).

The term "reduced" or "reduce" or "decrease" as used herein generally means a decrease by a statistically significant amount relative to a reference. For avoidance of doubt, "reduced" means statistically significant decrease of at least 10% as compared to a reference level, for example a decrease by at least 20%, at least 30%, at least 40%, at least t 50%, or least 60%, or least 70%, or least 80%, at least 90% or more, up to and including a 100% decrease (i.e., absent level as compared to a reference sample), or any decrease between 10-100% as compared to a reference level, as that term is defined herein.

The term "low" as used herein generally means lower by a statically significant amount; for the avoidance of doubt, "low" means a statistically significant value at least 10% lower than a reference level, for example a value at least 20% lower than a reference level, at least 30% lower than a reference level, at least 40% lower than a reference level, at least 50% lower than a reference level, at least 60% lower than a reference level, at least 70% lower than a reference level, at least 80% lower than a reference level, at least 90% lower than a reference level, up to and including 100% lower than a reference level (i.e., absent level as compared to a reference sample).

The terms "increased" or "increase" as used herein generally mean an increase by a statically significant amount; such as a statistically significant increase of at least 10% as compared to a reference level, including an increase of at least 20%, at least 30%, at least 40%, at least 50%, at least 60%, at least 70%, at least 80%, at least 90%, at least 100% or more, inclusive, including, for example at least 2 fold, at least 3-fold, at least 4-fold, at least 5-fold, at least 10-fold increase or greater as compared to a reference level, as that term is defined herein.

The term "high" as used herein generally means a higher by a statically significant amount relative to a reference; such as a statistically significant value at least 10% higher than a reference level, for example at least 20% higher, at least 30% higher, at least 40% higher, at least 50% higher, at least 60% higher, at least 70% higher, at least 80% higher, at least 90% higher, at least 100% higher, inclusive, such as at least 2-fold higher, at least 3-fold higher, at least 4-fold higher, at least 5-fold higher, at least 10-fold higher or more, as compared to a reference level.

As used herein and in the claims, the singular forms include the plural reference and vice versa unless the context clearly indicates otherwise. Other than in the operating examples, or where otherwise indicated, all numbers expressing quantities of ingredients or reaction conditions used herein should be understood as modified in all instances by the term "about."

As used herein, the terms "approximately" or "about" in reference to a number are generally taken to include numbers that fall within a range of 5%, 10%, 15%, or 20% in either direction (greater than or less than) of the number unless otherwise stated or otherwise evident from the context (except where such number would be less than 0% or exceed 100% of a possible value).

As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of elements that do not materially affect the basic and novel or functional characteristic(s) of that embodiment of the invention.

All patents and other publications identified are expressly incorporated herein by reference for the purpose of describing and disclosing, for example, the methodologies described in such publications that might be used in connection with the present invention. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

Unless defined otherwise, all technical and scientific terms used herein have the same meaning as those commonly understood to one of ordinary skill in the art to which this invention pertains. Although any known methods, devices, and materials may be used in the practice or testing of the invention, the methods, devices, and materials in this regard are described herein.

Pneumococcal Antigens

The inventors have previously demonstrated that one mechanism of protection against pneumococcal colonization was using a WCV (whole cell vaccine) that confers protection against both colonization and invasive disease in mice. (Malley et al., 69 Infect. Immun. 4870-73 (2001); Malley et al., 74 Infect. Immun. 4290-92 (2004).). It was previously demonstrated that protection against colonization following immunization with WCV (whole cell vaccine) is antibody-independent and dependent on CD4+ T cells (Malley et al., 102 P.N.A.S. USA 102, 4848-53 (2005); Trzcinski et al., 73 Infect. Immun. 7043-46 (2005)). The effector T cell is the CD4+ TH17 cell, with neutralization of IL-17A response with an anti IL-17A antibody diminished the protection by the WCV, and IL-17A receptor knockout mice are not protected by the WCV. In contrast, IFN-gamma or IL-4 deficient mice (which are skewed away from TH1 or TH2 responses, respectively) are fully protected (Lu et al., 4 PLoS Pathogens. e1000159 (2008)). Rats and mice immunized with the WCV are reported to be significantly protected against pneumococcal sepsis in two pneumonia models (Malley et al., 2001).

Using bioinformatics analysis as disclosed herein, the inventors have identified specific pneumococcal antigens which are listed in Table 1 which protect against pneumococcal colonization and infection, such as against pneumococcal sepsis infection. These pneumococcal antigens listed in Table 1 can be administered as vaccines, in the presence or absence of an adjuvant, to elicit a systemic IL-17A response and reduce or protect against intranasal pneumococcal colonization. In some embodiments, a pneumococcal antigen of any listed in Table 1 can be administered as mucosal vaccines to protect against intranasal pneumococcal colonization as well as pneumococcal infection, such as sepsis.

TABLE 1

Table 1 lists the amino acid sequence identification numbers of the pneumococcal immunogens. The amino acid sequences and nucleotide sequences of the pneumococcal antigens are available on world-wide web site: "xbase.ac.uk/genome/streptococcus-pneumoniae-tigr4/NC_003028/features?page=1", which is incorporated herein in its entirety by reference.

| Pneumococcal antigen name | Predicted functions | Protein SEQ ID NO: | DNA SEQ ID NO: | Gene ID NO. | GenBank Accession No | Immunogenic fragments of the pneumococcal antigen |
|---|---|---|---|---|---|---|
| SP0010 | hypothetical protein | 1 | 77 | 15899959 | NP_344563.1 | SP0010 (23-end) (SEQ ID NO: 153) |
| SP0043 | competence factor transport protein ComB | 2 | 78 | 15899988 | NP_344592.1 | SP0043 (42-end) (SEQ ID NO: 154) |
| SP0079 | potassium uptake protein, Trk family | 3 | 79 | 15900024 | NP_344628.1 | SP0079 (24-end) (SEQ ID NO: 155) |
| SP0084 | histidine kinase (EC 2.7.13.3) (IMGterm) | 4 | 80 | 15900028 | NP_344632.1 | SP0084 (110-end) (SEQ ID NO: 156) |
| SP0092 | carbohydrate ABC transporter substrate-binding protein, CUT1 family (TC 3.A.1.1.-) (IMGterm) | 5 | 81 | 15900035 | NP_344639.1 | SP0092 (30-end) (SEQ ID NO: 157) |
| SP0098 | hypothetical protein | 6 | 82 | 15900041 | NP_344645.1 | SP0098 (30-end) (SEQ ID NO: 158) |
| SP0106 | L-serine ammonia-lyase (EC 4.3.1.17) (IMGterm) | 7 | 83 | 15900049 | NP_344653.1 | SP0106 (29-end) (SEQ ID NO: 159) |
| SP0107 | LysM domain protein | 8 | 84 | 15900069 | NP_344673.1 | SP0107 (30-end) (SEQ ID NO: 160) |
| SP0127 | hypothetical protein | 9 | 85 | 15900069 | NP_344673.1 | SP0127 (26-end) (SEQ ID NO: 161) |
| SP0149 | lipoprotein | 10 | 86 | 15900087 | NP_344691.1 | SP0149 (25-end) (SEQ ID NO: 162) |

TABLE 1-continued

Table 1 lists the amino acid sequence identification numbers of the pneumococcal immunogens. The amino acid sequences and nucleotide sequences of the pneumococcal antigens are available on world-wide web site: "xbase.ac.uk/genome/streptococcus-pneumoniae-tigr4/NC_003028/features?page=1", which is incorporated herein in its entirety by reference.

| Pneumococcal antigen name | Predicted functions | Protein SEQ ID NO: | DNA SEQ ID NO: | Gene ID NO. | GenBank Accession No | Immunogenic fragments of the pneumococcal antigen |
|---|---|---|---|---|---|---|
| SP0191 | hypothetical protein | 11 | 87 | 15900128 | NP_344732.1 | SP0191 (26-end) (SEQ ID NO: 163) |
| SP0198 | hypothetical protein | 12 | 88 | 15900134 | NP_344738.1 | SP0198 (45-end) (SEQ ID NO: 164) |
| SP0249 | PTS system, IIB component | 13 | 89 | 15900184 | NP_344788.1 | SP0249 (26-end) (SEQ ID NO: 165) |
| SP0321 | PTS system, IIA component | 14 | 90 | 15900253 | NP_344857.1 | SP0321 (1-end) (SEQ ID NO: 14) |
| SP0346 | capsular polysaccharide biosynthesis protein Cps4A | 15 | 91 | 15900275 | NP_344879.1 | SP0346 (98-end) (SEQ ID NO: 166) |
| SP0402 | signal peptidase. Serine peptidase. MEROPS family S26A (IMGterm) | 16 | 92 | 15900321 | NP_344925.1 | SP0402 (29-end) (SEQ ID NO: 167) |
| SP0453 | amino acid ABC transporter substrate-binding protein, PAAT family (TC 3.A.1.3.-)/amino acid ABC transporter membrane protein, PAAT family (TC 3.A.1.3.-) (IMGterm) | 17 | 93 | 15900370 | NP_344974.1 | SP0453 (25-298) (SEQ ID NO: 168) |
| SP0564 | hypothetical protein | 18 | 94 | 15900476 | NP_345080.1 | SP0564 (21-end) (SEQ ID NO: 169) |
| SP0582 | hypothetical protein | 19 | 95 | 15900492 | NP_345096.1 | SP0582 (92-end) (SEQ ID NO: 170) |
| SP0589 | serine O-acetyltransferase (EC 2.3.1.30) (IMGterm) | 20 | 96 | 15900498 | NP_345102.1 | SP0589 (36-end) (SEQ ID NO: 171) |
| SP0601 | transmembrane protein Vexp3 | 21 | 97 | 15900509 | NP_345113.1 | SP0601 (36-297) (SEQ ID NO: 172) |
| SP0604 | sensor histidine kinase VncS | 22 | 98 | 15900512 | NP_345116.1 | SP0604 (223-end) (SEQ ID NO: 173) |
| SP0617 | hypothetical protein | 23 | 99 | 15900525 | NP_345129.1 | SP0617 (44-end) (SEQ ID NO: 174) |
| SP0620 | amino acid ABC transporter substrate-binding protein, PAAT family (TC 3.A.1.3.-) (IMGterm) | 24 | 100 | 15900528 | NP_345132.1 | SP0620 (27-end) (SEQ ID NO: 175) |
| SP0629 | D-Ala-D-Ala carboxypeptidase. Metallopeptidase. MEROPS family M15B (IMGterm) | 25 | 101 | 15900536 | NP_345140.1 | SP0629 (21-end) (SEQ ID NO: 176) |
| SP0648 | beta-galactosidase (EC:3.2.1.23) (IMGterm) | 26 | 102 | 15900551 | NP_345155.1 | SP0648 (40-776) (SEQ ID NO: 177), SP0648 (777-1676) (SEQ ID NO: 178), SP0648 (1677-end) (SEQ ID NO: 179) |
| SP0659 | thioredoxin family protein | 27 | 103 | 15900560 | NP_345164.1 | SP0659 (28-end) (SEQ ID NO: 180) |
| SP0662 | sensor histidine kinase, putative | 28 | 104 | 15900563 | NP_345167.1 | SP0662 (29-276) (SEQ ID NO: 181), SP0662 (300-end) (SEQ ID NO: 182) |
| SP0664 | zinc metalloprotease ZmpB | 29 | 105 | 15900565 | NP_345169.1 | SP0664 (103-629) (SEQ ID NO: 183), SP0664 (630-1200) (SEQ ID NO: 184), SP0664 (1201-end) (SEQ ID NO: 185) |
| SP0678 | hypothetical protein | 30 | 106 | 15900579 | NP_345183.1 | SP0678 (23-end) (SEQ ID NO: 186) |
| SP0724 | hydroxyethylthiazole kinase, putative | 31 | 107 | 15900621 | NP_345225.1 | SP0724 (35-end) (SEQ ID NO: 187) |

TABLE 1-continued

Table 1 lists the amino acid sequence identification numbers of the pneumococcal immunogens. The amino acid sequences and nucleotide sequences of the pneumococcal antigens are available on world-wide web site: "xbase.ac.uk/genome/streptococcus-pneumoniae-tigr4/NC_003028/features?page=1", which is incorporated herein in its entirety by reference.

| Pneumococcal antigen name | Predicted functions | Protein SEQ ID NO: | DNA SEQ ID NO: | Gene ID NO. | GenBank Accession No | Immunogenic fragments of the pneumococcal antigen |
| --- | --- | --- | --- | --- | --- | --- |
| SP0742 | hypothetical protein | 32 | 108 | 15900637 | NP_345241.1 | SP0742 (43-end) (SEQ ID NO: 188) |
| SP0757 | cell division protein FtsX (IMGterm) | 33 | 109 | 15900651 | NP_345255.1 | SP0757 (44-451) (SEQ ID NO: 189) |
| SP0785 | hypothetical protein | 34 | 110 | 15900678 | NP_345282.1 | SP0785 (33-end) (SEQ ID NO: 190) |
| SP0787 | hypothetical protein | 35 | 111 | 15900680 | NP_345284.1 | SP0787 (43-290) (SEQ ID NO: 191) |
| SP0872 | D,D-carboxypeptidase PBP3. Serine peptidase. MEROPS family S11 (IMGterm) | 36 | 112 | 15900755 | NP_345359.1 | SP0872 (30-end) (SEQ ID NO: 192) |
| SP0878 | SpoE family protein | 37 | 113 | 15900761 | NP_345365.1 | SP0878 (245-end) (SEQ ID NO: 193) |
| SP0899 | hypothetical protein | 38 | 114 | 15900781 | NP_345385.1 | SP0899 (31-end) (SEQ ID NO: 194) |
| SP1002 | adhesion lipoprotein | 39 | 115 | 15900875 | NP_345479.1 | SP1002 (22-end) (SEQ ID NO: 195) |
| SP1026 | hypothetical protein | 40 | 116 | 15900897 | NP_345501.1 | SP1026 (24-end) (SEQ ID NO: 196) |
| SP1032 | iron-compound ABC transporter, iron compound-binding protein | 41 | 117 | 15900903 | NP_345507.1 | SP1032 (22-end) (SEQ ID NO: 197) |
| SP1069 | hypothetical protein | 42 | 118 | 15900938 | NP_345542.1 | SP1069 (34-end) (SEQ ID NO: 198) |
| SP1154 | IgA1-specific metallopeptidase. Metallo peptidase. MEROPS family M26 (IMGterm) | 43 | 119 | 15901019 | NP_345623.1 | SP1154 (155-694) (SEQ ID NO: 199), SP1154 (695-1374) (SEQ ID NO: 200), SP1154 (1375-end) (SEQ ID NO: 201) |
| SP1267 | licC protein | 44 | 120 | 15901127 | NP_345731.1 | SP1267 (25-end) (SEQ ID NO: 202) |
| SP1376 | shikimate dehydrogenase (EC 1.1.1.25) (IMGterm) | 45 | 121 | 15901230 | NP_345834.1 | SP1376 (32-end) (SEQ ID NO: 203) |
| SP1386 | spermidine/putrescine ABC transporter, spermidine/putrescine-binding protein | 46 | 122 | 15901240 | NP_345844.1 | SP1386 (33-end) (SEQ ID NO: 204) |
| SP1404 | hypothetical protein | 47 | 123 | 15901258 | NP_345862.1 | SP1404 (31-end) (SEQ ID NO: 205) |
| SP1405 | transcriptional regulator Spx | 48 | 124 | 15901259 | NP_345863.1 | SP1405 (19-end) (SEQ ID NO: 206) |
| SP1419 | acetyltransferase, GNAT family | 49 | 125 | 15901272 | NP_345876.1 | SP1419 (27-end) (SEQ ID NO: 207) |
| SP1479 | peptidoglycan N-acetylglucosamine deacetylase A | 50 | 126 | 15901329 | NP_345933.1 | SP1479 (40-end) (SEQ ID NO: 208) |
| SP1500 | amino acid ABC transporter substrate-binding protein, PAAT family (TC 3.A.1.3.-) (IMGterm) | 51 | 127 | 15901347 | NP_345951.1 | SP1500 (27-end) (SEQ ID NO: 209) |
| SP1545 | hypothetical protein | 52 | 128 | 15901388 | NP_345992.1 | SP1545 (29-end) (SEQ ID NO: 210) |
| SP1560 | hypothetical protein | 53 | 129 | 15901403 | NP_346007.1 | SP1560 (28-end) (SEQ ID NO: 211) |
| SP1624 | 1-acyl-sn-glycerol-3-phosphate acyltransferase (EC 2.3.1.51) (IMGterm) | 54 | 130 | 15901460 | NP_346064.1 | SP1624 (1-217) (SEQ ID NO: 212) |
| SP1652 | hypothetical protein | 55 | 131 | 15901487 | NP_346091.1 | SP1652 (62-397) (SEQ ID NO: 213) |

TABLE 1-continued

Table 1 lists the amino acid sequence identification numbers of the pneumococcal immunogens. The amino acid sequences and nucleotide sequences of the pneumococcal antigens are available on world-wide web site: "xbase.ac.uk/genome/streptococcus-pneumoniae-tigr4/NC_003028/features?page=1", which is incorporated herein in its entirety by reference.

| Pneumococcal antigen name | Predicted functions | Protein SEQ ID NO: | DNA SEQ ID NO: | Gene ID NO. | GenBank Accession No | Immunogenic fragments of the pneumococcal antigen |
|---|---|---|---|---|---|---|
| SP1683 | carbohydrate ABC transporter substrate-binding protein, CUT1 family (TC 3.A.1.1.-) (IMGterm) | 56 | 132 | 15901518 | NP_346122.1 | SP1683 (65-end) (SEQ ID NO: 214) |
| SP1826 | ABC transporter, substrate-binding protein | 57 | 133 | 15901655 | NP_346259.1 | SP1826 (36-end) (SEQ ID NO: 215) |
| SP1872 | iron-compound ABC transporter, iron-compound-binding protein | 58 | 134 | 15901700 | NP_346304.1 | SP1872 (40-end) (SEQ ID NO: 216) |
| SP1891 | oligopeptide ABC transporter, oligopeptide-binding protein AmiA | 59 | 135 | 15901718 | NP_346322.1 | SP1891 (40-end) (SEQ ID NO: 217) |
| SP1897 | multiple sugar-binding protein (IMGterm) | 60 | 136 | 15901724 | NP_346328.1 | SP1897 (30-end) (SEQ ID NO: 218) |
| SP1942 | transcriptional regulator, putative | 61 | 137 | 15901766 | NP_346370.1 | SP1942 (37-end) (SEQ ID NO: 219) |
| SP1966 | UDP-N-acetylglucosamine 1-carboxyvinyltransferase (EC 2.5.1.7) (IMGterm) | 62 | 138 | 15901789 | NP_346393.1 | SP1966 (25-end) (SEQ ID NO: 220) |
| SP1967 | hypothetical protein | 63 | 139 | 15901790 | NP_346394.1 | SP1967 (30-end); (SEQ ID NO: 221) |
| SP1998 | L-asparaginase (EC 3.5.1.1) (IMGterm) | 64 | 140 | 15901821 | NP_346425.1 | SP1998 (51-end) (SEQ ID NO: 222) |
| SP2048 | hypothetical protein | 65 | 141 | 15901868 | NP_346472.1 | SP2048 (40-end) (SEQ ID NO: 223) |
| SP2050 | competence protein CglD | 66 | 142 | 15901870 | NP_346474.1 | SP2050 (35-end) (SEQ ID NO: 224) |
| SP2083 | sensor histidine kinase PnpS | 67 | 143 | 15901899 | NP_346503.1 | SP2083 (192-end) (SEQ ID NO: 225) |
| SP2084 | phosphate ABC transporter substrate-binding protein, PhoT family (TC 3.A.1.7.1) (IMGterm) | 68 | 144 | 15901900 | NP_346504.1 | SP2084 (30-end) (SEQ ID NO: 226) |
| SP2088 | phosphate uptake regulator, PhoU (IMGterm) | 69 | 145 | 15901904 | NP_346508.1 | SP2088 (30-end); (SEQ ID NO: 227) |
| SP2145 | antigen, cell wall surface anchor family | 70 | 146 | 15901958 | NP_346562.1 | SP2145 (1-end) (SEQ ID NO: 70) |
| SP2151 | carbamate kinase (EC 2.7.2.2) (IMGterm) | 71 | 147 | 15901963 | NP_346567.1 | SP2151 (25-end) (SEQ ID NO: 228) |
| SP2187 | hypothetical protein | 72 | 148 | 15901994 | NP_346598.1 | SP2187 (32-end); (SEQ ID NO: 229) |
| SP2192 | sensor histidine kinase | 73 | 149 | 15901999 | NP_346603.1 | SP2192 (224-end) (SEQ ID NO: 230) |
| SP2197 | ABC transporter, substrate-binding protein, putative | 74 | 150 | 15902004 | NP_346608.1 | SP2197 (30-end) (SEQ ID NO: 231) |
| SP2207 | competence protein ComF, putative | 75 | 151 | 15902014 | NP_346618.1 | SP2207 (30-end) (SEQ ID NO: 232) |
| SP2218 | rod shape-determining protein MreC (IMGterm) | 76 | 152 | 15902022 | NP_346626.1 | SP2218 (106-end) (SEQ ID NO: 234) |

In some cases, the other appropriate *S. pneumoniae* antigen is at least at least 70%, 80%, 85%, 90%, 95%, 97%, 98%, or 99% identity to the corresponding wild-type *S. pneumoniae* protein disclosed in Table 1. Sequences of the above-mentioned polypeptides, and nucleic acids that encode them, are known; see, for example, the *S. pneumoniae* ATCC 700669 complete genome sequence under GenBank accession number FM211187.1 and linked polypeptide sequences therein.

In addition to those nucleic acids and polypeptides described in Table 1 above, this application also provides immunogenic compositions that include one or more of the polypeptides or genes listed in Table 2, or variants or fragments thereof as described herein. The DNA and protein sequence of each gene and protein may be found by searching for the Locus Tag in the publicly available database, Entrez Gene, as described above.

In one aspect of the present invention provides immunogenic compositions (e.g., vaccines) comprising at least one isolated pneumococcus antigen selected from the pneumococcal proteins SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218, or fragments thereof. In some embodiments, the pneumococcal antigen has an amino acid sequence selected from any or a combination from SEQ ID NO: 1-76, or functional fragments thereof. In some embodiments, the pneumococcus antigen corresponding to SEQ ID NO: 1-76 are encoded by nucleic acids of SEQ ID NO: 77-152. In some embodiments, fragments of the pneumococcal antigen are encompassed for use in the methods and compositions as disclosed herein, for example, pneumococcus antigens corresponding to SEQ ID NO: 153-234 as disclosed in Table 1. Other functional fragments of the pneumococcus antigens are encompassed for use in the methods and compositions as disclosed herein, and can be assessed by one of ordinary skill in the art to determine if they provide protection against pneumococcus colonization, according to the methods as disclosed in Example 3 herein. A functional fragment of a pneumococcal antigen of SEQ ID NO: 1-76 or SEQ ID NO: 153-234 can also be assessed by one of ordinary skill in the art for protection against an invasive disease, such as sepsis according to the methods as disclosed in Example 4 and 5, in particular when used alone or as part of a fusion protein with PdT. In some embodiments, a functional fragment of a pneumococcal antigen of SEQ ID NO: 1-76 or SEQ ID NO: 153-234 can also be assessed by one of ordinary skill in the art for protection against an *S. typhi* according to the methods as disclosed in Example 5, in particular when used alone or as part of a fusion protein with PdT and/or fused to Vi.

In some embodiments, an immunogenic composition comprises at least one isolated pneumococcal antigen selected from any one or a combination of the pneumococcal antigens with the amino acid sequences SEQ ID NO: 1-76 or SEQ ID NO: 153-234. In some embodiments, the pneumococcal antigens are the full length pneumococcal proteins of SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218. In some embodiments, a pneumococcal antigen comprises a pneumococcal protein that lacks a signal sequence and/or transmembrane domain. In some embodiments, a pneumococcal antigen comprises a mixture of a full length pneumococcal proteins and fragments resulting from processing, or partial processing of a signal sequence by an expression host, e.g., *E. coli* or an insect cell line (e.g., the baculovirus expression system), or a mammalian (e.g., human or Chinese hamster Ovary (CHO)) cell line. As used herein, the terms "portion" and "fragment" or grammatical equivalents are used interchangeably.

In some embodiments, the pneumococcal antigens are a fragment of the full length pneumococcal proteins of SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218, for example, at least 7, 8, 9, 10, 11, 12, 13, 14, 15, 16, 17, 18, 19, 20, 25, 30, 35, 40, 45, 50, 55, 60, 65, 70, 75, 80, 85, 90, 100, 150, 200, 250, 300, 350 or 400 consecutive amino acids of such proteins. In some embodiments, fragment of the full-length pneumococcal protein correspond to SEQ ID NO: 153-234. In some embodiments, a fragment of a pneumococcal protein is a functional fragment of any of SEQ ID NO: 153-234, for example, at least 7, 8, 9, 10, 11, 12, 13, 14, 15, 16, 17, 18, 19, 20, 25, 30, 35, 40, 45, 50, 55, 60, 65, 70, 75, 80, 85, 90, 100, 150, 200, 250, 300, 350 or 400 consecutive amino acids of pneumococcal antigens corresponding to SEQ ID NO: 153-234.

In some embodiments, a pneumococcal antigen comprises an amino acid sequence which is at least 60% (e.g., at least 60%, at least 65%, at least 70%, at least 75%, at least 80%, at least 85%, at least 90%, at least 95%, at least 98% or at least 99%) identical to at 7, 8, 9, 10, 11, 12, 13, 14, 15, 16, 17, 18, 19, 20, 25, 30, 35, 40, 45, 50, 55, 60, 65, 70, 75, 80, 85, 90, 100, 150, 200, 250, 300, 350 or 400 consecutive amino acids of the pneumococcal proteins of SP0010, SP0043, SP0079, SP0084, SP0092, SP0098, SP0106, SP0107, SP0127, SP0149, SP0191, SP0198, SP0249, SP0321, SP0346, SP0402, SP0453, SP0564, SP0582, SP0589, SP0601, SP0604, SP0617, SP0620, SP0629, SP0648, SP0659, SP0662, SP0664, SP0678, SP0724, SP0742, SP0757, SP0785, SP0787, SP0872, SP0878, SP0899, SP1002, SP1026, SP1032, SP1069, SP1154, SP1267, SP1376, SP1386, SP1404, SP1405, SP1419, SP1479, SP1500, SP1545, SP1560, SP1624, SP1652, SP1683, SP1826, SP1872, SP1891, SP1897, SP1942, SP1966, SP1967, SP1998, SP2048, SP2050, SP2083, SP2084, SP2088, SP2145, SP2151, SP2187, SP2192, SP2197, SP2207 and SP2218, or fragments thereof, e.g., fragments of pneumococcal antigens corresponding to SEQ ID NO: 153-234.

The inventors demonstrate herein that the pneumococcal antigen SP0785 showed IL-17 response to protein stimulation and protection against pneumococcal colonization, and that SP0785-PdT protected 80% of mice from sepsis infection and SP0785-PdT-Vi protected against *Salmonella typhi* infection. The inventors also demonstrated that the pneumococcal antigen SP1500 elicited an IL-17 response to protein stimulation and protected against pneumococcal colonization, and also resulted in protection of 50% of mice from from pneumococcal infection, and that the pneumococcal antigen SP0346 protected 60% of mice from from pneumococcal infection and sepsis, that the pneumococcal antigens SP1386, SP0084 and SP1479 protected 50% of mice from from pneumococcal infection. The inventors also demonstrated that SP2145, when conjugated to PdT (SP2145-PdT) protected 80% of mice from sepsis infection and that SP2145-PdT-Vi protected against *S. typhi* infection. Accordingly, these antigens provide novel compositions for eliciting immune responses with the aim of eliciting beneficial immune responses, e.g., to protect against pneumococcal infections and associated pathogens. These antigens provide novel targets for characterizing pneumococcal infections and immune responses to pneumococcal infections.

Accordingly, in one aspect of the invention provides an immunogenic composition (e.g., vaccine) comprising an isolated pneumococcal antigen selected from a SP0785 polypeptide antigen, a SP1500 polypeptide antigen, a SP0346 polypeptide antigen, a SP1386 polypeptide antigen, a SP0084 polypeptide antigen, a SP1479 polypeptide antigen, a SP2145 polypeptide antigen, and combinations thereof.

In some embodiments, an immunogenic composition comprises a SP0785 pneumococcal polypeptide antigen. In some embodiments, a SP0785 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP0785 polypeptide sequence. In some embodiments, a SP0785 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:34. In some embodiments, a SP0785 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:35. In some embodiments, a SP0785 pneumococcal polypeptide antigen is encoded by SEQ ID NO: 110 or a fragment thereof. In some embodiments, functional fragment of a SP0785 pneumococcal polypeptide antigen comprises amino acids of SEQ ID NO: 190 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:190.

In some embodiments, an immunogenic composition comprises a SP1500 pneumococcal polypeptide antigen. In some embodiments, a SP1500 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP1500 polypeptide sequence. In some embodiments, a SP1500 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:51. In some embodiments, a SP1500 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:51. In some embodiments, a SP1500 pneumococcal polypeptide antigen is encoded by SEQ ID NO: 127 or a fragment thereof. In some embodiments, functional fragment of a SP1500 pneumococcal polypeptide antigen comprises amino acids of SEQ ID NO: 209 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:209.

In some embodiments, an immunogenic composition comprises a SP0346 pneumococcual polypeptide antigen. In some embodiments, a SP0346 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP0346 polypeptide sequence. In some embodiments, a SP0346 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:15. In some embodiments, a SP0346 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:15. In some embodiments, a SP0346 pneumococcal polypeptide antigen is encoded by SEQ ID NO: 91 or a fragment thereof. In some embodiments, functional fragment of a SP0346 pneumococcal polypeptide antigen comprises amino acids of SEQ ID NO: 166 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:166.

In some embodiments, an immunogenic composition comprises a SP1386 pneumococcal polypeptide antigen. In some embodiments, a SP1386 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP1386 polypeptide sequence. In some embodiments, a SP1386 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:46. In some embodiments, a SP1386 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:46. In some embodiments, a SP1386 pneumococcal polypeptide antigen is encoded by SEQ ID NO: 122 or a fragment thereof. In some embodiments, functional fragment of a SP1386 pneumococcal polypeptide antigen comprises amino acids of SEQ ID NO: 204 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO: 204.

In some embodiments, an immunogenic composition comprises a SP0084 pneumococcal polypeptide antigen. In some embodiments, a SP0084 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP0084 polypeptide sequence. In some embodiments, a SP0084 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:4. In some embodiments, a SP0084 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:4. In some embodiments, a SP0084 pneumococcal polypeptide antigen is encoded by the sequence shown in SEQ ID NO: 80 or a fragment thereof. In some embodiments, functional fragment of a SP0084 pneumococcal polypeptide antigen comprises amino acids of SEQ ID NO: 156 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:156.

In some embodiments, an immunogenic composition comprises a SP1479 pneumococcal polypeptide antigen. In some embodiments, a SP1479 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP1479 polypeptide sequence. In some embodiments, a SP1479 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:50. In some embodiments, a SP1479 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:50. In some embodiments, a SP1479 pneumococcal polypeptide antigen is encoded by the sequence shown in SEQ ID NO: 126 or a fragment thereof. In some embodiments, functional fragment of a SP1479 pneumococcal polypeptide antigen comprises amino acids of SEQ ID NO: 208 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO: 208.

In some embodiments, an immunogenic composition comprises a SP2145 pneumococcal polypeptide antigen. In some embodiments, a SP2145 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of a SP2145 polypeptide sequence. In some embodiments, a SP2145 polypeptide antigen comprises at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:70. In some embodiments, a SP2145 polypeptide antigen comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO:70. In some embodiments, a SP2145 pneumococcal polypeptide antigen is encoded by the sequence shown in SEQ ID NO: 146 or a fragment thereof. In some embodiments, functional fragment of a SP2145 pneumococcal polypeptide antigen comprises amino acids of SEQ ID NO: 70 or comprises an amino acid sequence that is at least 60% (e.g., at least 65%, 70%, 75%, 80%, 85%, 90%, 95%, or 98%) identical to at least 7, 8, 9, 10, 11, 12, 13, 14, 15, 16, 17, 18, 19, 20, 25, 30, 35, 45, 50, 60, 65, 70, 75, 80, 85, 90, 95, 100, 150, 200, 250, 300, 350, or 400 consecutive amino acids of the sequence shown in SEQ ID NO: 70.

In some embodiments, an immunogenic composition comprises two or more isolated pneumococcal antigens. In some embodiments, the two or more isolated antigens comprise two or more of a polypeptide antigens selected from Table 1. In some embodiments, the two or more isolated pneumococcal antigens comprise three or more of a polypeptide antigen selected from Table 1. In some embodiments, the two or more isolated pneumococcal antigens comprise four or more of a polypeptide antigen selected from Table 1. In some embodiments, the two or more isolated pneumococcal antigens comprise five, six, seven or more of a polypeptide antigen selected from Table 1. In some embodiments, the two or more isolated pneumococcal antigens comprise eight polypeptide antigens selected from Table 1.

The inventive pneumococcal antigens as described herein may be used in conjunction with other pneumococcal antigens such as those known in the art, such as those disclosed in US patent WO/2000/037105, U.S. Pat. Nos. 7,217,791 and 7,585,669, US2006/0121058, US2012/0251577, US2011/0159040, US2012/0189649, and US20110020386 which are incorporated herein in their entirety by reference. Other appropriate *S. pneumoniae* antigens for combination vaccines include Pneumococcal surface protein A (PspA);

derivatives of PspA, Choline-binding protein A (CbpA) and derivatives thereof; Pneumococcal surface adhesin A (PsaA); caseinolytic protease; sortase A (SrtA); pilus 1 RrgA adhesin; PpmA; PrtA; PavA; LytA; Stk-PR; PcsB; RrgB and derivatives thereof. For further details, see, e.g., A. D Ogunniyi et al., "Protection against *Streptococcus pneumoniae* elicited by immunization with pneumolysin and CbpA," Infect Immun. 2001 October; 69 (10):5997-6003; which is incorporated by reference herein in its entirety.

Derivatives of PspA include proline-rich segments with the non-proline block (PR+NPB, further described below as well as in Daniels, C. C. et al. (2010) Infection and Immunity 78:2163-72) and related constructs comprising all or a fragment of the proline-rich region of PspA (e.g., regions containing one or more of the sequences PAPAP (SEQ ID NO: 262), PKP, PKEPEQ (SEQ ID NO: 402) and PEKP (SEQ ID NO: 403) and optionally including a non-proline block). An example of the non-proline-block has the exemplary sequence EKSADQQAEEDYARRSEEEYNRLTQQQ (SEQ ID NO: 239), which generally has no proline residues in an otherwise proline-rich area of the non-coiled region of PspA. PspA and its derivatives can include genes expressing similar proline-rich structures (i.e. PKP, PKEPEQ (SEQ ID NO: 402) and PEKP (SEQ ID NO: 403)), with or without the NPB. The amino acids at either end of the NPB mark the boundaries of the proline-rich region. In one example, the amino-terminal boundary to the PR-region is DLKKAVNE (SEQ ID NO: 240), and the carboxy-terminal boundary is (K/G)TGW(K/G)QENGMW (SEQ ID NO: 241). Peptides containing the NPB are particularly immunogenic, suggesting that the NPB may be an important epitope. Exemplary immunogenic PspA polypeptides and derivatives thereof (e.g. with and without the coiled-coil structure are described, e.g., in International Patent Publication WO2013109995; which is incorporated by reference herein in its entirety Immunogenic PspA polypeptides include both PR and NPB sequences (PR+NPB) Immunogenic PspA polypeptides can include only a PR sequence (PR only) and lack the NPB.

In some embodiments, an immunogenic composition comprises an isolated pneumococcal polypeptide antigen selected from Table 1. In some embodiments, an immunogenic composition comprises two, three, four, five or more isolated pneumococcal polypeptide antigens selected from Table 1. In some embodiments, a pneumococcal antigen is fused to a heterologous polypeptide (e.g., an epitope tag). In some embodiments, an immunogenic composition comprising a pneumococcal antigen includes a pharmaceutically acceptable excipient.

While pneumococcal antigens are disclosed in WO/2000/037105, unlike in the present invention, in WO/2000/037105 their ability to induce a Th17 cell response was not assessed or known. Additionally, pneumococcal antigens are also disclosed in US application 2012/0189649 and US2012/0251577. However unlike the present invention, in the '649 and '577 applications, a whole genome library was used instead of purified proteins to screen for antigens which elicited a Th17 response, thus high expression levels of the antigens are likely to be required for an immunogenic effect or to elicit a Th17 response. In the present invention, purified pneumococcal antigen proteins are used, and thus has an advantage of very low background and requires lower expression levels of each pneumococcal antigen to induce an immunogenic effect and elicit a Th17 response, as demonstrated in the Examples.

The pneumococcal antigens as described herein can be prepared using recombinant DNA technology, purified from natural sources, or synthesized chemically. In some embodiments, where a pneumococcal antigen as described herein is fused or conjugated to PdT, the PdT can differ in amino acid sequence from a naturally occurring *S. pneumoniae* pneumolysin protein.

Nucleic acids encoding truncated and/or mutated forms of a pneumococcal antigen as described herein can be prepared, for example, by polymerase chain reaction (PCR). Nucleic acids encoding such proteins can be chosen for having codons, which are preferred or non-preferred, for a particular expression system. For example, the nucleic acid can be one in which at least one codon, preferably at least 10%, or 20% of the codons have been altered such that the sequence is optimized for expression in *E. coli*, yeast, human, insect, or CHO cells.

Nucleic acids encoding truncated and/or mutated forms of a pneumococcal antigen as described herein can be fused to nucleotide sequences encoding (1) other pneumococcal proteins, such as autolysin, surface protein A, neuraminidase, hyaluronate lysate, choline binding protein A, or (2) non-pneumococcal proteins from organisms such as hemophilus influenza b, meningococcus group A, B, or C, or *streptococcus* group B. The nucleic acids encoding such fused protein are expressed in the expression systems.

Pneumolysin truncates can be useful carriers of polysaccharides, as hosts may lacking pre-existing antibodies to such a carrier polypeptide. Pneumolysin is a virulence factor in pneumococcal infections and there is little antigenic variation of the pneumolysin among pneumococci with different subtypes.

A pneumococcal antigen as described herein, when administered to a mammal such as a human, when fused to a polysaccharide induces immune response that exceeds in magnitude, type, and/or duration the immune response induced by administration to a mammal of only the polysaccharide component. Accordingly, the pneumococcal antigen component must be of a length sufficient to induce such an enhanced immune response. For fragments of a naturally occurring pneumococcal antigen as described herein, the fragments are at least 8, 10, 25, 50, 75, 100, 125, 150, 175, 200, 250, 300, 350, 400, 425, 450, 460, 465, 460, 465, or more amino acids in length. For pneumococcal antigens, varying in sequence from a naturally occurring *S. pneumoniae* antigens as described herein, the polypeptide can be at least about 50%, 55%, 60%, 65%, 70%, 75%, 80%, 85%, 90%, 95%, 98% or more identical to a naturally occurring *S. pneumococcal* antigens as described herein in Table 1.

The polysaccharide component which can be conjugated to one or more of a pneumococcal antigen as described herein can be any *S. pneumoniae* capsular polysaccharide, including but not limited to, any of subtypes 1, 2, 3, 4, 5, 6B, 7F, 8, 9N, 9V, 10A, 11A, 12F, 14, 15B, 17F, 18C, 19A, 19F, 19A, 20, 22F, 23A, 23F, 24F, 27, 33F, or 34. In some embodiments, the capsular polysaccharide is selected from subtypes 4, 6B, 9V, 14, 18C, 19F, or 23F. In some embodiments, the polysaccharide is serotype 14. In other embodiments, the polysaccharide is serotype 18C. One or more of different capsular polysaccharides can be conjugated to a single polypeptide or a plurality of polypeptides. For example, a multivalent conjugate can include at least 1, 2, 3, 4, 5, 6, 7, 8, 9, or 10 different capsular polysaccharides. Polysaccharides can be conjugated to polypeptides, for example, via a monomeric linkage (only one end of the polysaccharide is attached to the polypeptide), a looped linkage (a single polypeptide is attached to looped polysaccharides), or cross-linked (multiple polysaccharides attached to multiple polypeptides).

Methods for the purification of polypeptides, e.g., a pneumococcal antigen as described herein, can be performed by one of ordinary skill in the art, and polypeptide or polysaccharide purification and conjugation processes are described in, e.g., U.S. Pat. Nos. 4,242,501; 4,686,102; 5,623,057; and 5,565,204, which are incorporated herein in its entirety by reference.

The immunogenic compositions described herein can be administered to a mammal to elicit an immune response (a prophylactic and/or therapeutic immune response) against *S. pneumoniae* in the mammal. A pharmaceutical composition containing a pneumococcal antigen, alone or as a conjugate can be delivered in a pharmaceutically acceptable carrier, buffer, or preservative which is suitable for a vaccine including, but not limited to, physiological saline or other injectable liquids. Additives customary in vaccines may also be present, for example stabilizers such as lactose or sorbitol, and adjuvants to enhance the immunogenic response such as aluminum phosphate, hydroxide, or sulphate and stearyl tyrosine. The vaccine produced may also be used as components of multivalent vaccines which elicit an immune response against a plurality of infectious agents.

The compositions can be administered in any manner known in the art, e.g., orally intramuscularly, intravenously, intraarterially, intrathecally, intradermally, intraperitoneally, intranasally, intrapulmonarily, intraocularly, intravaginally, intrarectally or subcutaneously. They can be introduced into the gastrointestinal tract or the respiratory tract, e.g., by inhalation of a solution or powder containing the conjugates. In some embodiments, the compositions can be administered via a skin patch.

A pharmaceutical composition (e.g., a vaccine) is administered in an amount sufficient to elicit production of antibodies as part of an immunogenic response. Dosage for any given patient depends upon many factors, including the patient's size, general health, sex, body surface area, age, the particular compound to be administered, time and route of administration, and other drugs being administered concurrently. Determination of optimal dosage is well within the abilities of a pharmacologist of ordinary skill.

The ability of a composition to elicit an immune response in a host mammal can be assayed by using methods for measuring immune responses that are well known in the art. For example, the generation of cytotoxic T cells can be demonstrated in a standard $^{51}$Cr release assay, by measuring intracellular cytokine expression or secretion, or by using major histocompatibility complex (MHC) tetramers. Standard assays, such as enzyme-linked immunosorbent assay (ELISA) or enzyme-linked immunospot (ELISPOT), can be used to measure cytokine profiles attributable to T cell activation. T cell proliferation can be measured using assays such as $^3$H-thymidine uptake and other assays known in the art. B cell responses can be measured using art recognized assays such as ELISA. Other methodologies can also be used to evaluate the effects of the conjugates on pathogen-associated lesions or on other pathogen levels generally (e.g., pneumococci clearance in challenged mice treated with the conjugate).

The composition described herein can be used in the manufacture of a medicament for the prevention or treatment of an infection with *S. pneumoniae* or conditions associated with such infection.

Adjuvants

In some embodiments, an immunogenic composition comprising a pneumococcal antigen includes an adjuvant. In some embodiments, an immunogenic composition includes a mineral-containing adjuvant. In some embodiments, the mineral-containing adjuvant includes aluminum hydroxide. In some embodiments, an immunogenic composition includes an adjuvant comprising an immunomodulatory oligonucleotide. In some embodiments, an immunogenic composition includes IC31™ adjuvant (Intercell AG). In some embodiments, an immunogenic composition includes an adjuvant comprising a toxin. In some embodiments, an immunogenic composition includes an adjuvant comprising an endotoxin. In some embodiments, an immunogenic composition includes an adjuvant comprising a muramyl dipeptide. In some embodiments, an immunogenic composition includes an adjuvant comprising an oil emulsion. In some embodiments, an immunogenic composition includes an adjuvant comprising a saponin. In some embodiments, an immunogenic composition includes an adjuvant comprising an immune stimulating complex (ISCOM). In some embodiments, an immunogenic composition includes an adjuvant comprising a nonionic block copolymer. In some embodiments, an immunogenic composition includes virus-like particles (VLPs), for example, a cholera toxin. In some embodiments, an immunogenic composition includes replicons. In some embodiments, an immunogenic composition includes an adjuvant comprising liposomes. In some embodiments, an immunogenic composition includes an adjuvant comprising microparticles. In some embodiments, an immunogenic composition includes an adjuvant comprising biodegradable microspheres. In some embodiments, an immunogenic composition includes an adjuvant comprising a cytokine. In some embodiments, an immunogenic composition includes an adjuvant comprising a lipopeptide.

Immunogenic compositions may contain adjuvants. In some embodiments, cholera toxin (CT) can be used as an adjuvant for intranasal administration, resulting in protection from pneumococcal colonization. Alum is an affective adjuvant for subcutaneous injection. Adjuvants are typically a heterogeneous group of substances that enhance the immunological response against an antigen that is administered simultaneously. In some instances, adjuvants are added to a vaccine to improve the immune response so that less vaccine is needed. Adjuvants serve to bring the antigen—the substance that stimulates the specific protective immune response—into contact with the immune system and influence the type of immunity produced, as well as the quality of the immune response (magnitude or duration). Adjuvants can also decrease the toxicity of certain antigens and provide solubility to some vaccine components. Almost all adjuvants used today for enhancement of the immune response against antigens are particles or form particles together with the antigen. In the book "Vaccine Design—the subunit and adjuvant approach" (Ed: Powell & Newman, Plenum Press, 1995) almost all known adjuvants are described both regarding their immunological activity and regarding their chemical characteristics. The type of adjuvants that do not form particles are a group of substances that act as immunological signal substances and that under normal conditions consist of the substances that are formed by the immune system as a consequence of the immunological activation after administration of particulate adjuvant systems.

Adjuvants for vaccines are well known in the art. Suitable additional adjuvants include, but are not limited to: complete Freund's adjuvant (CFA), incomplete Freund's adjuvant (IFA), saponin, mineral gels such as aluminum hydroxide, surface active substances such as lysolecithin, pluronic polyols, polyaninons, peptides, oil or hydrocarbon emulsions, keyhole limpet hemocyanins, dinitrophenol, and potentially useful human adjuvants such as BCG (bacille Calmette-Guerin) and *Corynebacterium parvum*. Selection of an adjuvant depends on the animal subject to be vaccinated. Additional examples include, but are not limited to, monoglycerides and fatty acids (e. g. a mixture of monoolein, oleic acid, and soybean oil); mineral salts, e.g., aluminium hydroxide and aluminium or calcium phosphate gels; oil emulsions and surfactant based formulations, e.g., MF59 (microfluidised detergent stabilized oil-in-water emulsion), QS21 (purified saponin), AS02 [SBAS2] (oil-in-water emulsion+MPL+QS-21), Montanide ISA-51 and ISA-720 (stabilized water-in-oil emulsion); particulate adjuvants, e.g., virosomes (unilamellar liposomal vehicles incorporating influenza haemagglutinin), AS04 ([SBAS4] Al salt with MPL), ISCOMS (structured complex of saponins and lipids), polylactide co-glycolide (PLG); microbial derivatives (natural and synthetic), e.g., monophosphoryl lipid A (MPL), Detox (MPL+*M. Phlei* cell wall skeleton), AGP [RC-529] (synthetic acylated monosaccharide), DC_Chol (lipoidal immunostimulators able to self organize into liposomes), OM-174 (lipid A derivative), CpG motifs (synthetic oligonucleotides containing immunostimulatory CpG motifs), modified LT and CT (genetically modified bacterial toxins to provide non-toxic adjuvant effects); endogenous human immunomodulators, e.g., hGM-CSF or hIL-12 (cytokines that can be administered either as protein or plasmid encoded), Immudaptin (C3d tandem array) and inert vehicles, such as gold particles. Newer adjuvants are described in U.S. Pat. No. 6,890,540, United States Patent Application No. 2005/0244420, and PCT/SE97/01003, and US2012/0135025, the contents of which are incorporated herein in their entirety by reference. The adjuvant can also be selected from the group consisting of QS-21, Detox-PC, MPL-SE, MoGM-CSF, TiterMax-G, CRL-1005, GERBU, TERamide, PSC97B, Adjumer, PG-026, GSK-I, GcMAF, B-alethine, MPC-026, Adjuvax, CpG ODN, Betafectin, Alum, and MF59.

In some embodiments, alternative adjuvants can be used, such as a pharmaceutically acceptable adjuvant. For example, oils or hydrocarbon emulsion adjuvants should not be used for human vaccination. One example of an adjuvant suitable for use with humans is alum (alumina gel). Details of common adjuvants which are contemplated to be added to the vaccine comprising an antigen as disclosed in Table 1 include those discussed below:

Complete Freund's Adjuvant (CFA): A mineral oil adjuvant; uses a water-in-oil emulsion which is primarily oil. For many years the adjuvant of choice was complete Freund's adjuvant. This adjuvant, while potent immunogenically, also has had a significant history of frequently producing abscesses, granulomas and tissue sloughs. It contains paraffin oil, killed mycobacteria and mannide monoosleate. The paraffin oil is not metabolized; it is either expressed through the skin (via a granuloma or abscess) or phagocytized by macrophages. Multiple exposures to CFA will cause severe hypersensitivity reactions. Accidental exposure of personnel to CFA can result in sensitization to tuberculin.

Incomplete Freund's Adjuvant (IFA): Also a mineral oil adjuvant. Composition similar to CFA but does not contain the killed mycobacteria so does not produce as severe reactions. Used for the booster immunizations following the initial injection with antigen-CFA. IFA can be used for initial injection if the antigen is strongly immunogenic.

Montanide ISA (Incomplete Seppic Adjuvant): A mineral oil adjuvant. Uses mannide oleate as the major surfactant component. The antibody response is generally similar to that with IFA. Montanide ISA may have a lessened inflammatory response.

Ribi Adjuvant System (RAS): An oil-in-water emulsion that contains detoxified endotoxin and mycobacterial cell wall components in 2% squalene. Multiple formulations are commercially available, dependent on use. Is an alternative to CFA. Lower viscosity than CFA. Results (titers) often comparable to those with CFA. The squalene oil is metabolizable. RAS has a lower incidence of toxic reactions.

TiterMax: Another water-in-oil emulsion, this preparation combines a synthetic adjuvant and microparticulate silica with the metabolizable oil squalene. The copolymer is the immunomodulator component. Antigen is bound to the copolymer and presented to the immune cells in a highly concentrated form. Less toxicity than CFA. TiterMax usually produces the same results as CFA.

Syntex Adjuvant Formulation (SAF): A preformed oil-in-water emulsion. Uses a block copolymer for a surfactant. A muramyl dipeptide derivative is the immunostimulatory component. All in squalene, a metabolizable oil. SAF can bias the humoral response to IgG2a in the mouse, but is less toxic than CFA.

Aluminum Salt Adjuvants: Most frequently used as adjuvants for vaccine antigen delivery. Generally weaker adjuvants than emulsion adjuvants. Aluminum Salt Adjuvants are best used with strongly immunogenic antigens, but result generally in mild inflammatory reactions.

Nitrocellulose-adsorbed antigen: The nitrocellulose is basically inert, leading to almost no inflammatory response. Slow degradation of nitrocellulose paper allows prolonged release of antigen. Does not produce as dramatic an antibody response as CFA. Nitrocellulose-adsorbed antigen is good for use if only a small amount of antigen can be recovered from a gel band, e.g., for animal immunization.

Encapsulated or entrapped antigens: Permits prolonged release of antigen over time; can also have immunostimulators in preparation for prolonged release. Preparation of encapsulated or entrapped antigens is complex.

Immune-stimulating complexes (ISCOMs): Antigen modified saponin/cholesterol micelles. Stable structures are formed which rapidly migrate to draining lymph nodes. Both cell-mediated and humoral immune responses are achieved. Low toxicity; ISCOMs can elicit significant antibody response. Quil A is one example, QS-21 is another.

GerbuR adjuvant: An aqueous phase adjuvant which uses immunostimulators in combination with zinc proline. GerbuR does not have a depot effect and has minimal inflammatory effect. GerbuR requires frequent boosting to maintain high titers.

Another group of adjuvants include immune stimulators such as cytokines IL-12, IL-4 and costimulatory molecules such as B7. A wide range of molecules having immune stimulating effects are known including accessory molecules such as ICAM and LFA. In some embodiments, GM-CSF is administered to the patient before the initial immune administration. GM-CSF can be administered using a viral vector or an isolated protein in a pharmaceutical formulation. Combinations of adjuvants can be used such as CM-CSF, ICAM and LFA. While a strong immune response is typically generated to infectious disease antigens, tumor associated antigens typically generate a weaker immune response. Thus, immune stimulators such as described above are preferably used with them.

In some embodiments, a pneumococcal vaccine can contain several pneumococcal antigens and/or be formulated with different or novel adjuvants, or incorporated in vaccine scaffolds, such as a fusion-conjugate (e.g., a fusion with a pneumolysoid and conjugation to a polysaccharide as proposed in Lu et al, Infection and Immunity, 2009), or using a scaffold, as disclosed in PCT/US12/37412 and WO 2012/155007 (which are incorporated herein in their entirety by reference) to improve immunogenicity and facilitate different routes of administration. Accordingly, a composition comprising at least 2, or at least about 3, or at least about 4, or at least about 5, or at least about 6, or at least about 7, or at least about 8, or at least about 9, or at least about 10, or at least about 12, or at least about 14, or at least about 16, or at least about 18, or at least about 20, or at least about 25, or any integer between about 2 and about 26 different antigens or more that 25 different antigens can be used, alone or in combination with an adjuvant and/or vaccine scaffold, such as a polysaccharide can be used.

In another aspect, the invention provides methods for eliciting an immune response against pneumococcus in a mammal. The methods include, for example, administering to the mammal an immunogenic composition comprising an isolated pneumococcal polypeptide antigen selected from Table 1 or fragments and combinations thereof, e.g., an immunogenic composition described herein.

In some embodiments, a method elicits an immune response against pneumococcus. In some embodiments, a method elicits a T cell response to a pneumococcal antigen (e.g., a CD4+ T cell mediated immune response and/or a CD8+ T cell mediated immune response). In some embodiments, a method elicits a Th1 T cell response. In some embodiments, a method elicits a Th17 T cell response. In some embodiments, a method elicits IFN-γ secretion by antigen-specific T cells. In some embodiments, a method elicits an antibody response (e.g., an IgG response, and/or an IgA response). In some embodiments, a method elicits a cytotoxic T cell (CTL) response. In some embodiments, a method elicits a B cell-mediated immune response. In some embodiments, a method elicits both a T cell- and a B cell-mediated response. In some embodiments, a method elicits an innate immune response.

In some embodiments, a method reduces the incidence of pneumococcal infection in subjects administered the composition. In some embodiments, a method reduces the likelihood of lower tract infection by a pneumococcus. In some embodiments, a method reduces the likelihood of upper tract infection by a pneumococcal organism. In some embodiments, a method reduces the likelihood of chronic infection by a pneumococcal organism. In some embodiments, a method reduces the likelihood of suffering from pelvic inflammatory disease due to a pneumococcal infection. In some embodiments, a method reduces the likelihood of infertility subsequent to a pneumococcal infection.

In some embodiments of a method, an immunogenic composition is administered to the mammal at least two times (e.g., two, three, four, or five times).

In some embodiments, an immunogenic composition administered after a first administration (i.e., as a boost) differs from the composition administered initially, e.g., the composition includes a different pneumococcal antigen or a different subset of pneumococcal antigens, or a different pneumococcal antigen substance (polypeptide or nucleic acid encoding same), or a different dose of antigen, or a different adjuvant, or a different dose of adjuvant. In some embodiments, a boost is administered by a different route than a previous administration.

In some embodiments, the mammal is at risk for infection with pneumococcus. In some embodiments, the mammal is infected with a pneumococcal infection. In some embodiments, the mammal is a human.

In some embodiments, an immunogenic composition administered in a method comprises an adjuvant. In some embodiments, an adjuvant is a mineral-containing adjuvant. In some embodiments, an immunogenic composition administered in a method comprises a pharmaceutically acceptable excipient.

In some embodiments, a pneumococcal antigen composition includes an adjuvant. In some embodiments, the adjuvant includes mineral-containing adjuvant. Mineral-containing adjuvants can be formulated as gels, in crystalline form, in amorphous form, as particles, etc. Mineral-containing adjuvants include, for example, aluminum salts and/or calcium salts (e.g., aluminum hydroxide, aluminum phosphate, aluminum sulfate, calcium phosphate, etc.). In some embodiments, a pneumococcal antigen composition includes aluminum hydroxide. Alhydrogel™ is an example of an aluminum hydroxide gel adjuvant.

In some embodiments, an adjuvant includes an immunomodulatory oligonucleotide. In some embodiments, an immunomodulatory oligonucleotide sequence includes CpG (unmethylated cytosine-guanosine) motifs. Oligonucleotides having CpG motifs can include nucleotide analogs and/or non-naturally occurring internucleoside linkages (e.g., phosphorothioate linkages). For examples of various oligonucleotides include CpG motifs, see Kandimalla, et al., Nuc. Acids Res. 31(9): 2393-2400, 2003; WO02/26757; WO99/62923; Krieg, Nat. Med. 9(7): 831-835, 2003; McCluskie, et al., FEMS Immunol Med. Microbiol. 32:179-185, 2002; WO98/40100; U.S. Pat. Nos. 6,207,646; 6,239,116 and 6,429,199. Other immunomodulatory nucleotide sequences double stranded RNA sequences, palindromic sequences, and poly(dG) sequences.

In some embodiments, an adjuvant comprises IC.sub.31™ (Intercell AG). IC31™ is a synthetic adjuvant that includes an antimicrobial peptide, KLK, and an immunostimulatory oligonucleotide, ODN1a, and acts as a Toll-like Receptor 9 (TLR9) agonist. In some embodiments, an adjuvant includes a toxin. In some embodiments, a toxin is a bacterial ADP-ribosylating toxin, e.g., cholera toxin (CT), E. coli heat labile toxin, or pertussis toxin. In some embodiments, the bacterial toxin is a detoxified form of an ADP-ribosylating toxin (see, e.g., Beignon, et al., Inf. Immun. 70(6):3012-3019, 2002; Pizza, et al., Vaccine 19:2534-2541, 2001; Pizza, et al., Int. J. Med. Microbiol. 290(4-5):455-461, 2000; Scharton-Kersten et al., Inf. Immun. 68(9):5306-5313, 2000; Ryan et al., Inf. Immun 67(12):6270-6280, 1999; Partidos et al., Immunol Lett. 67(3):209-216, 1999; Peppoloni et al., Vaccines 2(2):285-293, 2003; and Pine et al., J. Control Release 85(1-3):263-270, 2002). In some embodiments, an adjuvant includes an endotoxin such as monophosphoryl lipid A or 3-De-O-acylated monophosphoryl lipid A (see U.S. Pat. No. 4,987,237 and GB 2122204B).

In some embodiments, an adjuvant includes a muramyl dipeptide (e.g., N-acetyl-muramyl-L-threonyl-D-isoglutamine(thr-MDP), N-acetyl-normuramyl-1-alanyl-d-isoglutamine(nor-MDP), and N-acetylmuramyl-1-alanyl-d-isoglutaminyl-1-alanine-2-(1'-2'-dipalmitoyl-s-n-glycero-3-hydroxyphosphoryloxy)-ethylamine MTP-PE). In some, an adjuvant includes an oil emulsion and/or emulsifier-based adjuvant. In some embodiments, an oil emulsion adjuvant includes a Freund's Adjuvant (e.g., Complete Freund's adjuvant (CFA), or incomplete Freund's adjuvant (IFA)). In some embodiments, an oil-emulsion adjuvant includes a squalene water emulsion, such as MF59 (Novartis; see, e.g., WO9014837), or a Synex adjuvant formulation (SAF)). In some embodiments, an oil emulsion includes a dispersing agent, e.g., a mono- or di-C.sub.12-C.sub.24-fatty acid ester of sorbitan or mannide, e.g., sorbitan mono-stearate, sorbitan mon-oleate, or mannide mono-oleate. Examples of oil emulsions that include squalene and dispersing agents includes Arlacel™, Montanide™ ISA-720, and Montanide™ ISA-703. Other oil emulsions are described, e.g., in WO 95/17210 and EP 0399842.

In some embodiments, an adjuvant includes a saponin. Saponins are steroid and/or triterpenoid glycosides derived from plants such as *Quillaja saponaria, Saponaria officianalis, Smilax ornata*, and *Gypsophilla paniculata*. Fractions of saponin-containing extracts that have been described and that can be used as adjuvants for pneumococcal antigens include Quil™A, QS21, QS7, QS17, QS18, QH-A, QH-B, QH-C, and QuilA (see, e.g., U.S. Pat. No. 5,057,540). In some embodiments, QS21 is used as an adjuvant.

In some embodiments, an adjuvant includes an immune stimulating complex (ISCOM). ISCOMs are particles that typically include a glycoside (e.g., a saponin) and a lipid. In some embodiments, an ISCOM includes a saponin and a cholesterol. In some embodiments, an ISCOM includes a saponin, a cholesterol, and a phospholipid (e.g., phosphatidylcholine and/or phosphatidylethanolamine). In some embodiments, an ISCOM includes a nonionic block copolymer. ISCOMs can include additional adjuvants, e.g., additional adjuvant substances described herein (see, e.g., WO 05/002620). In some embodiments, an ISCOM includes a substance that targets it to a mucosal membrane (see, e.g., WO97/030728). Other ISCOM compositions and preparation of the compositions suitable for combination with pneumococcal antigens provided herein are described, e.g., in U.S. Pat. Pub. No. 20060121065, WO 00/07621, WO 04/004762, WO 02/26255, and WO 06/078213. In some embodiments, an adjuvant comprises an AbISCO® adjuvant (e.g., Matrix-M™, Isconova). In some embodiments, an adjuvant comprises AbISCO®-100. In some embodiments, an adjuvant comprises AbISCO®-300.

In some embodiments, an adjuvant includes a nonionic block copolymer. Nonionic block copolymers typically include two chains of hydrophobic polyoxyethylenes of various lengths combined with a block of hydrophobic polyoxypropylene. In some embodiments, a nonionic block copolymer is formulated in an oil-in-water emulsion (e.g., with oil and squalene).

In some embodiments, an adjuvant includes virus like particles (VLPs). VLPs are non replicating, non infectious particles that typically include one or more viral proteins, optionally formulated with an additional component such as a phospholipid. In some embodiments, a VLP includes proteins from one or more of the following: an influenza virus (e.g., a hemaglutinin (HA) or neuraminidase (NA) polyptide), Hepatitis B virus (e.g., a core or capsid polypeptide), Hepatitis E virus, measles virus, Sindbis virus, Rotavirus, Foot-and-Mouth Disease virus, Retrovirus, Norwalk virus, human papilloma virus, HIV, RNA-phages, Q13-phage (e.g., a coat protein), GA-phage, fr-phage, AP205 phage, a Ty (e.g., retrotransposon Ty protein p1). See, e.g., WO03/024480, WO03/024481, WO08/061,243, and WO07/098,186. In some embodiments, an adjuvant includes replicons. Replicons resemble VLPs in that they are noninfectious particles including viral proteins, and further include a nucleic acid encoding a polypeptide (e.g., an antigen). In some embodiments, a replicon includes proteins from an alphavirus. Alphaviruses include, e.g., Eastern Equine Encephalitis Virus (EEE), Venezuelan Equine Encephalitis Virus (VEE), Everglades Virus, Mucambo Virus, Pixuna Virus, Western Equine Encephalitis Virus (WEE), Sindbis Virus, Semliki Forest Virus, Middleburg Virus, Chikungunya Virus, O'nyong-nyong Virus, Ross River Virus, Barmah Forest Virus, Getah Virus, Sagiyama Virus, Bebaru Virus, Mayaro Virus, Una Virus, Aura Virus, Whataroa Virus, Babanki Virus, Kyzylagach Virus, Highlands J Virus, Fort Morgan Virus, Ndumu Virus, and Buggy Creek Virus. In some embodiments, an adjuvant includes a replicon that includes a nucleic acid encoding one or more pneumococcal antigens described herein. In some embodiments, an adjuvant includes a replicon that encodes a cytokine (e.g., interleukin-12 (IL-12), IL-23, or granulocyte-macrophage colony-stimulating factor (GM-CSF)). Production and uses of replicons are described, e.g., in WO08/058, 035, WO08/085,557, and WO08/033,966). In some embodiments, a VLP or replicon adjuvant includes one or more pneumococcal antigens (i.e., VLP or replicon particles include a pneumococcal antigen as part of the particles). In some embodiments, a VLP or replicon adjuvant is co-administered with a pneumococcal antigen polypeptide.

In some embodiments, an adjuvant includes liposomes, which are are artificially-constructed spherical lipid vesicles (see, e.g., U.S. Pat. Nos. 4,053,585; 6,090,406; and 5,916, 588). In certain embodiments, a lipid to be used in liposomes can be, but is not limited to, one or a plurality of the following: phosphatidylcholine, lipid A, cholesterol, dolichol, sphingosine, sphingomyelin, ceramide, glycosyl-ceramide, cerebroside, sulfatide, phytosphingosine, phosphatidyl-ethanolamine, phosphatidylglycerol, phosphatidylinositol, phosphatidylserine, cardiolipin, phosphatidic acid, and lyso-phosphatides. In some embodiments, an adjuvant includes a liposome and a ligand for a Toll-like Receptor (TLR; see, e.g., WO/2005/013891, WO/2005/079511, WO/2005/079506, and WO/2005/013891). In some embodiments, an adjuvant includes JVRS-100. JVRS-100 comprises cationic liposomes combined with non-coding oligonucleotides or plasmids.

In some embodiments, an adjuvant includes microparticles comprised of a polymer, e.g., a polymer of acrylic or methacrylic acid, polyphosphazenes, polycarbonates, polylactic acid, polyglycolic acid, copolymers of lactic acid or glycolic acid, polyhydroxybutyric acid, polyorthoesters, polyanhydrides, polysiloxanes, polycaprolactone, or a copolymer prepared from the monomers of these polymers. In some embodiments, an adjuvant includes microparticles comprised of a polymer selected from the group consisting of polyvinylpyrrolidone, polyvinylalcohol, polyhydroxyethylmethacrylate, polyacrylamide, polymethacrylamide, and polyethyleneglycol (see, e.g., U.S. Pat. No. 5,500,161).

In some embodiments, an adjuvant includes biodegradable microspheres (e.g., microspheres comprised of poly(D, L-lactic acid), poly(D,L-glycolic acid), poly(.epsilon.-caprolactone), polye (.alpha.-hydroxy actid), polyhydroxybutyric acid, a polyorthoester, a polyanhydride, etc.).

In some embodiments, an adjuvant includes a cytokine. In some embodiments, an adjuvant includes IL-12. In some embodiments, an adjuvant includes IL-23. In some embodiments, an adjuvant includes GM-CSF. In some embodiments, an adjuvant includes a lipopeptide. In some embodiments, an adjuvant includes a Pam-3-Cys lipopeptide. In some embodiments, an adjuvant including a lipopeptide activates Toll-like receptors (TLRs).

Additional Components of Vaccines or Immunogenic Compositions

In addition to the antigens and the adjuvants described above, a vaccine formulation or immunogenic composition may include one or more additional components.

In certain embodiments, the vaccine formulation or immunogenic composition may include one or more stabilizers such as sugars (such as sucrose, glucose, or fructose), phosphate (such as sodium phosphate dibasic, potassium phosphate monobasic, dibasic potassium phosphate, or monosodium phosphate), glutamate (such as monosodium L-glutamate), gelatin (such as processed gelatin, hydrolyzed gelatin, or porcine gelatin), amino acids (such as arginine, asparagine, histidine, L-histidine, alanine, valine, leucine, isoleucine, serine, threonine, lysine, phenylalanine, tyrosine, and the alkyl esters thereof), inosine, or sodium borate.

In certain embodiments, the vaccine formulation or immunogenic composition includes one or more buffers such as a mixture of sodium bicarbonate and ascorbic acid. In some embodiments, the vaccine formulation may be administered in saline, such as phosphate buffered saline (PBS), or distilled water.

In certain embodiments, the vaccine formulation or immunogenic composition includes one or more surfactants such as polysorbate 80 (Tween 80), Triton X-100, Polyethylene glycol tert-octylphenyl ether t-Octylphenoxypolyethoxyethanol 4-(1,1,3,3-Tetramethylbutyl)phenyl-polyethylene glycol (TRITON X-100); Polyoxyethylenesorbitan monolaurate Polyethylene glycol sorbitan monolaurate (TWEEN 20); and 4-(1,1,3,3-Tetramethylbutyl)phenol polymer with formaldehyde and oxirane (TYLOXAPOL). A surfactant can be ionic or nonionic.

In certain embodiments, the vaccine formulation or immunogenic composition includes one or more salts such as sodium chloride, ammonium chloride, calcium chloride, or potassium chloride.

In certain embodiments, a preservative is included in the vaccine or immunogenic composition. In other embodiments, no preservative is used. A preservative is most often used in multi-dose vaccine vials, and is less often needed in single-dose vaccine vials. In certain embodiments, the preservative is 2-phenoxyethanol, methyl and propyl parabens, benzyl alcohol, and/or sorbic acid.

In certain embodiments, the vaccine formulation or immunogenic composition is a controlled release formulation.

Modifications

In some embodiments, the vaccine can comprise at least one immunogen of the sequences listed in Table 1, or an immunogen which is a functional fragment or has substantial identity to an immunogen listed in Table 1. Further *S. pneumoniae* antigens as disclosed herein for combination vaccines include conjugated *S. pneumoniae* polysaccharides. The conjugated polysaccharides may be, for example, as described in U.S. Pat. Nos. 5,623,057, 5,371,197, or PCT/US2011/023526, which are incorporated herein in their entirety.

In some embodiments, the pneumococcal antigens described herein may be used with or without modification. In some embodiments, a pneumococcal antigen may be modified to elicit the desired immune response. In some embodiments, a pneumococcal antigen is conjugated to an appropriate immunogenic carrier such as tetanus toxin, pneumolysin, keyhole limpet hemocyanin, or the like.

In some embodiments, one or more pneumococcal antigen is present in a scaffold, such as a fusion-conjugate (e.g., a fusion with a pneumolysoid and conjugation to a polysaccharide as proposed in Lu et al, Infection and Immunity, 2009), or using a scaffold, as disclosed in PCT/US12/37412, WO 2012/155007 and US2011/0206716, which are incorporated herein in its entirety by reference.

In some embodiments, a pneumococcal polypeptide antigen is fused to PdT. In some embodiments, PdT represents a nonhemolytic variant of pneumolysin, or a nonhemolytic variant of pneumolysin (PdT) (W433F, D385N, and C428G).

In some embodiments, a pneumococcal polypeptide antigen can exist as a conjugate to provide for a synergistic immunogenic reaction to an antigenic sugar moiety. For example, the Vi polysaccharide of *Salmonella typhi* could be used. Vi capsular polysaccharide has been developed against bacterial enteric infections, such as typhoid fever (Robbins et al., 150(3) J. Infect. Dis. 436-49 (1984); Levine et al., 7 Baillieres Clin. Gastroenterol. 501-17 (1993)). Vi is a polymer of α-1→4-galacturonic acid with an N acetyl at position C-2 and variable 0-acetylation at C-3. The virulence of *S. typhi* correlates with the expression of this molecule (Sharma et al., 101 P.N.A.S. USA 17492-97 (2004)). The Vi polysaccharide vaccine of *S. typhi* has several advantages: Side effects are infrequent and mild, a single dose yields consistent immunogenicity and efficacy. Vi polysaccharide may be reliably standardized by physicochemical methods verified for other polysaccharide vaccines, Vi is stable at room temperature and it may be administered simultaneously with other vaccines without affecting immunogenicity and tolerability (Azze et al., 21 Vaccine 2758-60 (2003)).

Thus, the Vi polysaccharide of *Salmonella typhi* may be conjugated to a fusion protein of a pneumococcal polypeptide antigen, where the pneumococcal polypeptide antigen is fused to PdT or another protein, such that the resulting vaccine confers immunity against one pathogen, or two different pathogens: where the pneumococcal polypeptide antigen confers protection against pneumococcus, a Vi-pneumococcal antigen:PdT construct raises an immunogenic response against *S. typhi* and pneumococcus. Other examples include combining sugars from encapsulated bacteria (such as meningococcus, *S. aureus*, pneumococcus, etc.) and tuberculous protein, to provide a vaccine that protects against two different pathogens.

Other polysaccharide (PS) moieties that may be used in the present invention in alternative to dextran, pneumococcal cell wall polysaccharide (CWPS) etc., include carbohydrate antigens of cancers. For example, the Tn antigen, an oligosaccharide expressed exclusively by cancer cells (Buskus et al., 44 Angew Chem. Int'l Ed. 5985-88 (2005)). In some embodiment, the present invention provides for an immunogenic composition comprising a fusion protein of a truncated pneumococcal antigen and a nonhemolytic pneumolysin PdT protein, conjugated with CWPS.

In one aspect of the invention, the polysaccharide has a molecular mass of <500 kDa. In another aspect of the invention, the PS has a molecular mass of <70 kDa.

In some embodiments, a pneumococcal antigen as disclosed herein is present in an immunogenic multiple antigen presenting system (MAPS) as disclosed in WO 2012/155007, which is incorporated herein in its entirety by reference, where the pneumococcal antigen as disclosed herein in present in an immunogenic complex comprising at least one type of polymer, e.g., a polysaccharide, that can, optionally, be antigenic; at least one pneumococcal antigen as disclosed herein; and at least one complementary affinity-molecule pair comprising (i) a first affinity molecule that associates with the polymer, and (ii) a complementary affinity molecule that associates with the protein or peptide; such that the first and complementary affinity molecules serve as an indirect link between the polymer with the antigenic protein or peptide. Accordingly, the polymer can attach at least 1, or at least 2, or a plurality of the same or different protein or peptide antigens. In some embodiments, the polymer is antigenic, e.g., the polymer is a pneumococcal capsular polysaccharide. In some embodiments, the pneumococcal antigens are recombinant pneumococcal antigens. Accordingly, one aspect of the present invention relates to an immunogenic composition comprising a polymer, at least one pneumococcal antigen, and at least one complementary affinity-molecule pair, where the complementary affinity-molecule pair comprises a first affinity molecule that associates with the polymer and a complementary affinity molecule that associates with the pneumococcal antigen, so that when the first affinity molecule associates with the complementary affinity molecule, it indirectly links the antigen to the polymer.

In some embodiments, a first affinity molecule in a immunogenic complex is cross-linked to the polymer with a cross-linking reagent, for example, a cross-linking reagent selected from CDAP (1-cyano-4-dimethylaminopyridinium tetrafluoroborate), EDC (1-Ethyl-3-[3-dimethylaminopropyl]carbodiimide hydrochloride), sodium cyanoborohydride; cyanogen bromide; or ammonium bicarbonate/iodoacetic acid. In some embodiments, the first affinity molecule is cross-linked to carboxyl, hydroxyl, amino, phenoxyl, hemiacetal, and mecapto functional groups of the polymer. In some embodiments, the first affinity molecule is covalently bonded to the polymer. In some embodiments, the first affinity molecule is biotin or a derivative thereof, or a molecule with similar structure or physical property as biotin, for example, an amine-PEG3-biotin ((+)-biotinylation-3-6,9-trixaundecanediamine) or derivative thereof.

In some embodiments, a pneumococcal antigen of the immunogenic complex is a fusion protein comprising a pneumococcal antigenic protein or peptide fused to the complementary affinity-binding molecule. The fusion can be a genetic construct, i.e., a recombinant fusion peptide or protein. In some embodiments, a pneumococcal antigen can be covalently attached as a fusion protein to the complementary affinity molecule. In alternative embodiments, the antigen is non-covalently attached to the complementary affinity molecule.

In some embodiments, a complementary affinity molecule in an immunogenic complex is a biotin-binding protein or a derivative or a functional portion thereof. In some embodiments, a complementary affinity molecule is an avidin-like protein or a derivative or a functional portion thereof, for example but not limited to, rhizavidin or a derivative thereof. In some embodiments, a complementary affinity molecule is avidin or streptavidin or a derivative or a functional portion thereof.

In some embodiments, a polymer of the immunogenic complex is branched chain polymer, e.g., a branched polysaccharide, or alternatively, can be a straight chain polymer, e.g., a single chain polymer, e.g., polysaccharide. In some embodiments, the polymer is a polysaccharide, for example, dextran or a derivative thereof. In some embodiments, a polymer, e.g., dextran polysaccharide can be of average molecular weight of 425 kD 500 kDa, inclusive, or in some embodiments, greater than 500 kDa. In some embodiments, a polymer, e.g., dextran polysaccharide can be of average molecular weight of 60 kD-90 kDa, inclusive, or in some embodiments, smaller than 70 kDa. The dextran polymer can be derived from a bacterium, such as *Leuconostoc mesenteroides*.

In some embodiments, an immunogenic composition as disclosed herein comprises at least 2 antigens, or at 3 least antigens, or at least 5 antigens, or between 2-10 antigens, or between 10-15 antigens, or between 15-20 antigens, or between 20-50 antigens, or between 50 100 antigens, or more than 100 antigens, inclusive. In some embodiments, where an immunogenic composition as disclosed herein comprises at least 2 antigens, the antigens can be the same antigen or at least 2 different antigens. In some embodiments, the antigens can be from the same or different pathogens, or can be different epitopes or parts of the same antigenic protein, or can be the same antigen which is specific to different serotypes or seasonal variations of the same pathogen (e.g., influenza virus A, B, and C).

A pneumococcal antigen as disclosed herein when present alone, or in an immunogenic complex can elicit both humoral and cellular responses to one or multiple antigens at the same time. The immunogenic compositions provide for a long-lasting memory response, potentially protecting a subject from future infection. This allows for a single immunogenic composition that raises a high titer of functional anti-polysaccharide antibody, and is similar or compares favorably with the antibody level induced by conventional conjugate vaccine In another embodiment of the present invention, an immunogenic composition can comprise a fusion protein polysaccharide conjugate, consisting of a pneumococcal antigen selected from Table 1, fused to PdT, where the pneumococcal antigen:PdT fusion protein is conjugated to a polysaccharide, such that immunity to pneumococcal antigen is enhanced. The polysaccharide may be dextran, a Vi polysaccharide of *Salmonella typhi*, or pneumococcal cell wall polysaccharide (CWPS), or another polysaccharide of prokaryotic or eukaryotic origin.

Nucleic acids encoding truncated and/or mutated forms of a *S. pneumoniae* protein antigens can be fused to nucleotide sequences encoding (1) other pneumococcal proteins, such as autolysin, surface protein A, neuraminidase, hyaluronate lysate, choline binding protein A, or (2) non-pneumococcal proteins from organisms such as hemophilus influenza b, meningococcus group A, B, or C, or *streptococcus* group B. The nucleic acids encoding such fused protein are expressed in the expression systems.

Pneumolysin truncates can be useful carriers of polysaccharides, as hosts may lacking pre-existing antibodies to such a carrier polypeptide. Pneumolysin is a virulence factor in pneumococcal infections and there is little antigenic variation of the pneumolysin among pneumococci with different subtypes.

The polysaccharide-protein conjugate, when administered to a mammal such as a human, induces immune response that exceeds in magnitude, type, and/or duration the immune response induced by administration to a mammal of only the polysaccharide component. Accordingly, the polypeptide component must be of a length sufficient to induce such an enhanced immune response. For fragments of a naturally occurring pneumococcal antigen, the fragments are at least 8, 10, 25, 50, 75, 100, 125, 150, 175, 200, 250, 300, 350, 400, 425, 450, 460, 465, 460, 465, or more amino acids in length. For polypeptides, varying in sequence from a naturally occurring pneumococcal antigens, the polypeptide can be at least about 50%, 55%, 60%, 65%, 70%, 75%, 80%, 85%, 90%, 95%, 98% or more identical to a naturally occurring pneumococcal antigens listed in Table 1.

The polysaccharide component of the conjugate can be any *S. pneumoniae* capsular polysaccharide, including but not limited to, any of subtypes 1, 2, 3, 4, 5, 6B, 7F, 8, 9N, 9V, 10A, 11A, 12F, 14, 15B, 17F, 18C, 19A, 19F, 19A, 20, 22F, 23A, 23F, 24F, 27, 33F, or 34. In some embodiments, the capsular polysaccharide is selected from subtypes 4, 6B, 9V, 14, 18C, 19F, or 23F. In some embodiments, the polysaccharide is serotype 14. In other embodiments, the polysaccharide is serotype 18C. One or more of different capsular polysaccharides can be conjugated to a single polypeptide or a plurality of polypeptides. For example, a multivalent conjugate can include at least 1, 2, 3, 4, 5, 6, 7, 8, 9, or 10 different capsular polysaccharides. Polysaccharides can be conjugated to polypeptides, for example, via a monomeric linkage (only one end of the polysaccharide is attached to the polypeptide), a looped linkage (a single polypeptide is attached to looped polysaccharides), or cross-linked (multiple polysaccharides attached to multiple polypeptides).

Methods for the purification of polypeptides, e.g., pneumococcal antigen polypeptides described in the examples and in Table 1, and the conjugation of polysaccharides to polypeptides are described in in, e.g., U.S. Pat. Nos. 4,242, 501; 4,686,102; 5,623,057; and 5,565,204, which are incorporated herein in their entirety by reference.

The conjugates or polypeptides described herein can be administered to a mammal to elicit an immune response (a prophylactic and/or therapeutic immune response) against S. pneumoniae in the mammal. A pharmaceutical composition containing a conjugate or polypeptide can be delivered in a pharmaceutically acceptable carrier, buffer, or preservative which is suitable for a vaccine including, but not limited to physiological saline or other injectable liquids. Additives customary in vaccines may also be present, for example stabilizers such as lactose or sorbitol, and adjuvants to enhance the immunogenic response such as aluminum phosphate, hydroxide, or sulphate and stearyl tyrosine. The vaccine produced may also be used as components of multivalent vaccines which elicit an immune response against a plurality of infectious agents.

In some embodiments, a pneumococcal polypeptide antigen is post-translationally modified, e.g. by phosphorylation, myristoylation, acylation, glycosylation, glycation, and the like. In some embodiments, a pneumococcal polypeptide antigen is lipidated. Conjugation to the lipid moiety may be direct or indirect (e.g., via a linker). The lipid moiety may be synthetic or naturally produced. In some embodiments, a pneumococcal polypeptide antigen is chemically conjugated to a lipid moiety. In some embodiments, a DNA construct encoding a pneumococcal polypeptide antigen comprises a lipidation sequence. A lipidation sequence may be N-terminal or C-terminal to the polypeptide, and may be embedded in a signal or other sequence. An exemplary lipidation sequence is the signal sequence of the E. coli gene RlpB.

In some embodiments, a pneumococcal polypeptide antigen is covalently bound to another molecule. This may, for example, increase the half-life, solubility, bioavailability, or immunogenicity of the antigen. Molecules that may be covalently bound to the antigen include a carbohydrate, biotin, poly(ethylene glycol) (PEG), polysialic acid, N-propionylated polysialic acid, nucleic acids, polysaccharides, and PLGA. In some embodiments, the naturally produced form of a polypeptide is covalently bound to a moiety that stimulates the immune system. An example of such a moiety is a lipid moiety. In some instances, lipid moieties are recognized by a Toll-like receptor (TLR) such as TLR2 or TLR4 and activate the innate immune system.

DNA Vaccines; Nucleic Acid Compositions and Antigen Expression

In certain aspects, the vaccine comprises one or more of the nucleic acids disclosed herein or corresponding to the polypeptides described herein. When a nucleic acid vaccine is administered to a patient, the corresponding gene product (such as a desired antigen) is produced in the patient's body. In some embodiments, nucleic acid vaccine vectors that include optimized recombinant polynucleotides can be delivered to a mammal (including humans) to induce a therapeutic or prophylactic immune response. The nucleic acid may be, for example, DNA, RNA, or a synthetic nucleic acid. The nucleic acid may be single stranded or double stranded.

Various types of vectors are suitable for expression of pneumococcal antigens in an expression system (e.g., in a host cell). In some embodiments, a composition includes a vector suitable for expression in vitro (whether in a cell or in a cell-free system), e.g., for producing a polypeptide composition. The term "vector" refers to a nucleic acid molecule capable of transporting another nucleic acid to which it has been linked and can include, for example, a plasmid, cosmid or viral vector. The vector can be capable of autonomous replication or it can integrate into a host DNA. Viral vectors include, e.g., replication defective retroviruses, adenoviruses and adeno-associated viruses. Other types of viral vectors are known in the art.

Nucleic acid vaccine vectors (e.g., adenoviruses, liposomes, papillomaviruses, retroviruses, etc.) can be administered directly to the mammal for transduction of cells in vivo. The nucleic acid vaccines can be formulated as pharmaceutical compositions for administration in any suitable manner, including parenteral administration. Plasmid vectors are typically more efficient for gene transfer to muscle tissue. The potential to deliver DNA vectors to mucosal surfaces by oral administration has also been reported (PLGA encapsulated Rotavirus and Hepatitis B) and DNA plasmids have been utilized for direct introduction of genes into other tissues. DNA vaccines have been introduced into animals primarily by intramuscular injection, by gene gun delivery, or by electroporation. After being introduced, the plasmids are generally maintained episomally without replication. Expression of the encoded proteins has been shown to persist for extended time periods, providing stimulation of B and T cells.

In determining the effective amount of the vector to be administered in the treatment or prophylaxis of an infection or other condition, the physician evaluates vector toxicities, progression of the disease, and the production of anti-vector antibodies, if any. Often, the dose equivalent of a naked nucleic acid from a vector is from about 1 μg to 1 mg for a typical 70 kilogram patient, and doses of vectors used to deliver the nucleic acid are calculated to yield an equivalent amount of therapeutic nucleic acid. Administration can be accomplished via single or divided doses. The toxicity and therapeutic efficacy of the nucleic acid vaccine vectors can be determined using standard pharmaceutical procedures in cell cultures or experimental animals.

A nucleic acid vaccine can contain DNA, RNA, a modified nucleic acid, or a combination thereof. In some embodiments, the vaccine comprises one or more cloning or expression vectors; for instance, the vaccine may comprise a plurality of expression vectors each capable of autonomous expression of a nucleotide coding region in a mammalian cell to produce at least one immunogenic polypeptide. An expression vector often includes a eukaryotic promoter sequence, such as the nucleotide sequence of a strong eukaryotic promoter, operably linked to one or more coding regions. The compositions and methods herein may involve the use of any particular eukaryotic promoter, and a wide variety are known; such as a CMV or RSV promoter. The promoter can be heterologous with respect to the host cell. The promoter used may be a constitutive promoter.

A vector useful in the present compositions and methods can be circular or linear, single-stranded or double stranded and can be a plasmid, cosmid, or episome. In a suitable embodiment, each nucleotide coding region is on a separate vector; however, it is to be understood that one or more coding regions can be present on a single vector, and these coding regions can be under the control of a single or multiple promoters.

Numerous plasmids may be used for the production of nucleic acid vaccines. Suitable embodiments of the nucleic acid vaccine employ constructs using the plasmids VR1012 (Vical Inc., San Diego Calif.), pCMVI.UBF3/2 (S. Johnston, University of Texas) or pcDNA3.1 (InVitrogen Corporation, Carlsbad, Calif.) as the vector. In addition, the vector construct can contain immunostimulatory sequences (ISS), such as unmethylated dCpG motifs, that stimulate the animal's immune system. The nucleic acid vaccine can also encode a fusion product containing the immunogenic polypeptide. Plasmid DNA can also be delivered using attenuated bacteria as delivery system, a method that is suitable for DNA vaccines that are administered orally. Bacteria are transformed with an independently replicating plasmid, which becomes released into the host cell cytoplasm following the death of the attenuated bacterium in the host cell.

DNA vaccines, including the DNA encoding the desired antigen, can be introduced into a host cell in any suitable form including, the fragment alone, a linearized plasmid, a circular plasmid, a plasmid capable of replication, an episome, RNA, etc. Preferably, the gene is contained in a plasmid. In certain embodiments, the plasmid is an expression vector. Individual expression vectors capable of expressing the genetic material can be produced using standard recombinant techniques. See e.g., Maniatis et al., 1985 Molecular Cloning: A Laboratory Manual or DNA Cloning, Vol. I and II (D. N. Glover, ed., 1985) for general cloning methods.

Routes of administration include, but are not limited to, intramuscular, intranasal, intraperitoneal, intradermal, subcutaneous, intravenous, intraarterially, intraoccularly and oral as well as topically, transdermally, by inhalation or suppository or to mucosal tissue such as by lavage to vaginal, rectal, urethral, buccal and sublingual tissue. Typical routes of administration include intramuscular, intraperitoneal, intradermal and subcutaneous injection. Genetic constructs may be administered by means including, but not limited to, traditional syringes, needleless injection devices, "microprojectile bombardment gene guns", or other physical methods such as electroporation ("EP"), "hydrodynamic method", or ultrasound. DNA vaccines can be delivered by any method that can be used to deliver DNA as long as the DNA is expressed and the desired antigen is made in the cell.

In some embodiments, a DNA vaccine is delivered via known transfection reagents such as cationic liposomes, fluorocarbon emulsion, cochleate, tubules, gold particles, biodegradable microspheres, or cationic polymers. *Cochleae* delivery vehicles are stable phospholipid calcium precipitants consisting of phosphatidyl serine, cholesterol, and calcium; this nontoxic and noninflammatory transfection reagent can be present in a digestive system. Biodegradable microspheres comprise polymers such as poly(lactide-co-glycolide), a polyester that can be used in producing microcapsules of DNA for transfection. Lipid-based microtubes often consist of a lipid of spirally wound two layers packed with their edges joined to each other. When a tubule is used, the nucleic acid can be arranged in the central hollow part thereof for delivery and controlled release into the body of an animal.

In some embodiments, DNA vaccine is delivered to mucosal surfaces via microspheres. Bioadhesive microspheres can be prepared using different techniques and can be tailored to adhere to any mucosal tissue including those found in eye, nasal cavity, urinary tract, colon and gastrointestinal tract, offering the possibilities of localized as well as systemic controlled release of vaccines. Application of bioadhesive microspheres to specific mucosal tissues can also be used for localized vaccine action. In some embodiments, an alternative approach for mucosal vaccine delivery is the direct administration to mucosal surfaces of a plasmid DNA expression vector which encodes the gene for a specific protein antigen.

The DNA plasmid vaccines according to the present invention are formulated according to the mode of administration to be used. In some embodiments where DNA plasmid vaccines are injectable compositions, they are sterile, and/or pyrogen free and/or particulate free. In some embodiments, an isotonic formulation is preferably used. Generally, additives for isotonicity can include sodium chloride, dextrose, mannitol, sorbitol and lactose. In some embodiments, isotonic solutions such as phosphate buffered saline are preferred. In some embodiments, stabilizers include gelatin and albumin. In some embodiments, a vasoconstriction agent is added to the formulation. In some embodiments, a stabilizing agent that allows the formulation to be stable at room or ambient temperature for extended periods of time, such as LGS or other polycations or polyanions is added to the formulation.

In some embodiments, the DNA vaccine may further comprises a pharmacologically acceptable carrier or diluent. Suitable carriers for the vaccine are well known to those skilled in the art and include but are not limited to proteins, sugars, etc. Such carriers may be aqueous or non-aqueous solutions, suspensions, and emulsions. Examples of non-aqueous carriers are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose and sodium chloride, lactated Ringer's or fixed oils. Intravenous vehicles include fluid and nutrient replenishers, electrolyte replenishers such as those based on Ringer's dextrose, and the like. Preservatives and antimicrobials include antioxidants, chelating agents, inert gases and the like. Preferred preservatives include formalin, thimerosal, neomycin, polymyxin B and amphotericin B.

An alternative approach to delivering the nucleic acid to an animal involves the use of a viral or bacterial vector. Examples of suitable viral vectors include adenovirus, polio virus, pox viruses such as vaccinia, canary pox, and fowl pox, herpes viruses, including catfish herpes virus, adenovirus-associated vector, and retroviruses. Exemplary bacterial vectors include attenuated forms of *Salmonella, Shigella, Edwardsiella ictaluri, Yersinia ruckerii,* and *Listeria monocytogenes*. In some embodiments, the nucleic acid is a vector, such as a plasmid, that is capable of autologous expression of the nucleotide sequence encoding the immunogenic polypeptide.

A vector can include a nucleic acid encoding a pneumococcal antigen in a form suitable for expression of the nucleic acid in a host cell. A recombinant expression vector typically includes one or more regulatory sequences operatively linked to the nucleic acid sequence to be expressed. Regulatory sequences include promoters, enhancers and other expression control elements (e.g., polyadenylation signals). Regulatory sequences include those which direct constitutive expression of a nucleotide sequence, as well as tissue-specific regulatory and/or inducible sequences. A sequence encoding a pneumococcal antigen can include a sequence encoding a signal peptide (e.g., a heterologous signal peptide) such that the antigen is secreted from a host cell. The design of the expression vector can depend on such factors as the choice of the host cell to be transformed, the level of expression of protein desired, and the like.

Recombinant expression vectors can be designed for expression and production of pneumococcal antigens in prokaryotic or eukaryotic cells. For example, antigens can be expressed in E. coli, insect cells (e.g., using baculovirus expression vectors), yeast cells or mammalian cells. Suitable host cells are discussed further in Goeddel, Gene Expression Technology Methods in Enzymology 185, Academic Press, San Diego, Calif., 1990. Alternatively, a recombinant expression vector can be transcribed and translated in vitro, for example using T7 promoter regulatory sequences and T7 polymerase.

Expression of polypeptides in prokaryotes is often carried out in E. coli with vectors containing constitutive or inducible promoters directing the expression of either fusion or non-fusion proteins. Fusion vectors add a number of amino acids to a protein encoded therein, e.g., to the amino terminus or carboxy terminus of the recombinant protein, e.g., to increase expression of recombinant protein; to increase the solubility of the recombinant protein; and/or to aid in the purification of the recombinant antigen by acting as a ligand in affinity purification. Often, a proteolytic cleavage site is introduced at the junction of the fusion moiety and the recombinant antigen to enable separation of the recombinant antigen from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. Gene 67:31-40, 1988), pMAL (New England Biolabs, Beverly, Mass.) and pRITS (Pharmacia, Piscataway, N.J.) which fuse glutathione S-transferase (GST), maltose E binding protein, or protein A, respectively, to the target recombinant protein. Pneumococcal antigen expression vectors provided herein include yeast expression vectors, vectors for expression in insect cells (e.g., a baculovirus expression vector) and vectors suitable for expression in mammalian cells.

An expression vector for use in mammalian cells can include viral regulatory elements. For example, commonly used promoters are derived from polyoma, Adenovirus 2, cytomegalovirus and Simian Virus 40. A vector can include an inducible promoter, e.g., a promoter regulated by a steroid hormone, by a polypeptide hormone (e.g., by means of a signal transduction pathway), or by a heterologous polypeptide (e.g., the tetracycline-inducible systems, "Tet-On" and "Tet-Off"; see, e.g., Clontech Inc., CA, Gossen and Bujard, Proc. Natl. Acad. Sci. USA 89:5547, 1992, and Paillard, Human Gene Therapy 9:983, 1989).

A host cell can be any prokaryotic or eukaryotic cell. For example, a pneumococcal antigen can be expressed in bacterial cells (such as E. coli), insect cells, yeast or mammalian cells (such as Chinese hamster ovary cells (CHO) or COS cells (African green monkey kidney cells CV-1 origin SV40 cells; Gluzman, Cell 23:175-182, 1981). Other suitable host cells are known to those skilled in the art.

Vector DNA can be introduced into host cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, gene gun, or electroporation.

A host cell can be used to produce (i.e., express) a pneumococcal antigen. Accordingly, the invention further provides methods for producing a pneumococcal antigen using host cells. In one embodiment, the method includes culturing a host cell (into which a recombinant expression vector encoding a pneumococcal antigen has been introduced) in a suitable medium such that a pneumococcal antigen is produced. In another embodiment, the method further includes isolating a pneumococcal antigen from the medium or the host cell. Purified pneumococcal antigens can be used for administration to mammals to induce an immune response, and/or to generate antibodies specific for the antigens.

The present invention also provides nucleic acid compositions that encode pneumococcal antigens for administration to a subject in vivo, e.g., to elicit an immune response to the antigen. In some embodiments, a nucleic acid composition for administration in vivo includes a naked DNA plasmid encoding a pneumococcal antigen. Bacterial vectors, replicon vectors, live attenuated bacteria, and viral vectors for expression of heterologous genes also can be used. Live attenuated viral vectors (e.g., recombinant vaccinia (e.g., modified vaccinia Ankara (MVA), IDT Germany), recombinant adenovirus, avian poxvirus (e.g., canarypox (e.g., ALVAC™, Aventis Pasteur) or fowlpox), poliovirus, and alphavirus virion vectors) have been successful in inducing cell-mediated immune response to antigens. Avian poxviruses are defective in mammalian hosts, but can express inserted heterologous genes under early promoters. Recombinant adenovirus and poliovirus vectors can thrive in the gut and so can stimulate efficient mucosal immune responses. Finally, attenuated bacteria can also be used as a vehicle for DNA vaccine delivery. Examples of suitable bacteria include S. enterica, S. tymphimurium, Listeria, and BCG. The use of mutant bacteria with weak cell walls can aid the exit of DNA plasmids from the bacterium.

Nucleic acid compositions used for immunization can include an adjuvant (e.g., an adjuvant such as a polymer, a saponin, muramyl dipeptide, liposomes, immunomodulatory oligonucleotide, or another adjuvant described herein) to promote nucleic acid uptake. Regardless of route, adjuvants can be administered before, during, or after administration of the nucleic acid. In some embodiments, an adjuvant increases the uptake of nucleic acid into host cells and/or increases expression of the antigen from the nucleic acid within the cell, induce antigen-presenting cells to infiltrate the region of tissue where the antigen is being expressed, or increase the antigen-specific response provided by lymphocytes.

The terms "homology", "identity" and "similarity" refer to the degree of sequence similarity between two peptides or between two optimally aligned nucleic acid molecules. Homology and identity can each be determined by comparing a position in each sequence which can be aligned for purposes of comparison. For example, it is based upon using a standard homology software in the default position, such as BLAST, version 2.2.14. When an equivalent position in the compared sequences is occupied by the same base or amino acid, then the molecules are identical at that position; when the equivalent site occupied by similar amino acid residues (e.g., similar in steric and/or electronic nature such as, for example conservative amino acid substitutions), then the molecules can be referred to as homologous (similar) at that position. Expression as a percentage of homology/ similarity or identity refers to a function of the number of similar or identical amino acids at positions shared by the compared sequences, respectively. A sequence which is "unrelated" or "non-homologous" shares less than 40% identity, though preferably less than 25% identity with the sequences as disclosed herein.

In some embodiments, a pneumococcal antigen is a variant of a pneumococcal antigen of Table 1 which is substantial identical to a sequence of SEQ ID NO: 1-76 or SEQ ID NO: 153-234. The term "substantial identity" as used herein denotes a characteristic of a polynucleotide or amino acid sequence, wherein the polynucleotide or amino acid comprises a sequence that has at least 85% sequence identity, preferably at least 90% to 95% sequence identity, more usually at least 99% sequence identity as compared to a reference sequence over a comparison window of at least 18 nucleotide (6 amino acid) positions, frequently over a window of at least 24-48 nucleotide (8-16 amino acid) positions, wherein the percentage of sequence identity is calculated by comparing the reference sequence to the sequence which can include deletions or additions which total 20 percent or less of the reference sequence over the comparison window. The reference sequence can be a subset of a larger sequence. The term "similarity", when used to describe a polypeptide, is determined by comparing the amino acid sequence and the conserved amino acid substitutes of one polypeptide to the sequence of a second polypeptide.

In some embodiments, a pneumococcal antigen is homologous to a sequence of SEQ ID NO: 1-76 or SEQ ID NO: 153-234. As used herein, the terms "homologous" or "homologues" are used interchangeably, and when used to describe a polynucleotide or polypeptide, indicates that two polynucleotides or polypeptides, or designated sequences thereof, when optimally aligned and compared, for example using BLAST, version 2.2.14 with default parameters for an alignment (see herein) are identical, with appropriate nucleotide insertions or deletions or amino-acid insertions or deletions, in at least 60% of the nucleotides, usually from about 75% to 99%, and more preferably at least about 98 to 99% of the nucleotides. The term "homolog" or "homologous" as used herein also refers to homology with respect to structure and/or function. With respect to sequence homology, sequences are homologs if they are at least 60 at least 70%, at least 80%, at least 90%, at least 95% identical, at least 97% identical, or at least 99% identical. Determination of homologs of the genes or peptides of the present invention can be easily ascertained by the skilled artisan.

In some cases, it there may be advantages to designing vaccines based on antigens that are "surface-expressed" rather than cytoplasmic. Annotated genomes often describes protein location based on homology with other identified proteins, but this may be an imperfect or often incorrect approach, as homologous proteins form two different organisms may not necessarily be located at the same site (nor have the same function) in both. Thus, an additional tool for determination of the location of the protein (surface versus other) may be very helpful and may also be used in the chloroform method described herein.

An embodiment of the present method comprises identifying a protein, "X" of interest, then removing the gene encoding for X from the organism, then replacing that gene with a gene encoding for a tagged version of the X protein (e.g., tagged with His, HA, OVA peptide, among others), which can be detected readily with monoclonal or polyclonal antibodies. After confirmation of the genetic construct, the organism is then grown, stained with an antibody that recognizes the tag (and is also fused to a fluorophore). Flow cytometry is then used to evaluate whether the antibodies are attached to the surface of the organism, in which case, the antigen can be deduced to be surface-expressed. Similar strategies using antibodies attached to magnetic beads can be used as well. For pneumococcus, for example, the organism can be evaluated in its encapsulated or unencapsulated form. An antigen can be surface expressed, but hidden under the capsule, for selection of antigen purposes, it may be advantageous to select an antigen that is both surface expressed and accessible despite capsulation.

The identified immunogenic proteins or mixtures thereof may be used in a multivalent or individual vaccine, which can be administered in many forms (intramuscularly, subcutaneously, mucosally, transdermally). For example, combinations or permutations of the twelve pneumococcal immunogens may be more efficacious against colonization versus disease. A combination of several immunogens with both characteristics may provide a superior vaccine.

Antibodies

Antibodies directed against a pneumococcal antigen or functional fragment thereof as disclosed in Table 1 may be used in a prophylactic or therapeutic application to confer immunity from a first individual to a second individual (e.g., to augment the second individual's immune response against *S. pneumoniae* or to provide a response if the second individual is an immunocompromised patient). Antibodies directed against a a pneumococcal antigen as disclosed herein can be generated in an immunocompetent host (e.g., by administering to the immunocompetent host a conjugate described herein), harvested from the host and transfused into a recipient in need of treatment or prophylaxis, thereby conferring resistance to the recipient against not only the pneumolysin toxin, but also against *S. pneumoniae* and any possibly other bacteria which bind antibodies elicited by the pneumococcal antigen.

Antibodies elicited by a composition described herein can be formulated as a pharmaceutical composition and be used to confer a prophylactic or therapeutic immune response to an individual. Suitable components and methods of administration for pharmaceutical compositions are described herein. For eliciting passive immunity, the pharmaceutical composition may contain polyclonal antibodies or monoclonal antibodies or their derivatives of fragments. A pharmaceutical composition contains a prophylactically or therapeutically effective amount of an antibody, fragment, or derivative, as determined by standard clinical techniques.

Accordingly, this invention provides, inter alia, antibodies, or antigen-binding fragments thereof, to a novel pneumococcal antigen described herein, e.g., those listed in Table 1, or a SP0785 polypeptide antigen, a SP1500 polypeptide antigen, a SP0346 polypeptide antigen, a SP1386 polypeptide antigen, a SP0084 polypeptide antigen, a SP1479 polypeptide antigen, a CT067 polypeptide antigen, a CT476 polypeptide antigen, a p6 polypeptide antigen, a SP2145 polypeptide antigen, or any pneumococcal antigen listed in Table 1, e.g., SEQ ID NO: 1-76 or SEQ ID NO: 153-234), or functional fragments or variants thereof. The antibodies can be of the various isotypes, including: IgG (e.g., IgG1, IgG2, IgG3, IgG4), IgM, IgA1, IgA2, IgD, or IgE. In some embodiments, an antibody is an IgG isotype, e.g., IgG1. An antibody against a pneumococcal antigen can be full-length (e.g., an IgG1 or IgG4 antibody) or can include only an antigen-binding fragment (e.g., a Fab, F(ab)$_2$, Fv or a single chain Fv fragment). These include monoclonal antibodies, recombinant antibodies, chimeric antibodies, human antibodies, and humanized antibodies, as well as antigen-binding fragments of the foregoing.

Monoclonal antibodies can be produced by a variety of techniques, including conventional monoclonal antibody methodology, e.g., the standard somatic cell hybridization technique of Kohler and Milstein, Nature 256: 495, 1975. Polyclonal antibodies can be produced by immunization of animal or human subjects. See generally, Harlow, E. and Lane, D. Antibodies: A Laboratory Manual, Cold Spring Harbor Laboratory Press, Cold Spring Harbor, N. Y., 1988. Antibodies against pneumococcal antigens described herein can be used, e.g., for diagnostic assays, or for therapeutic applications.

In some embodiments of the present invention, a subject's response to an immunogenic composition described herein is evaluated, e.g., to determine efficacy of the composition, and/or to compare responses elicited by the composition to responses elicited by a different composition.

Nucleic Acids Encoding Pneumococcal Polypeptide Antigens

Nucleic acids encoding a pneumococcal polypeptide antigen or a fragment or variant of pneumococcal polypeptide can be administered to a mammal (e.g., a human) to generate a prophylactic and/or therapeutic immune response in the mammal. The immune response can be an anti-pneumococcal humoral and/or a cellular immune response.

Polypeptides that can be encoded by the nucleic acid constructs include one or more pneumococcal polypeptide antigens, alone or fused to a fusion polypeptide, e.g. PdT and/or a polysaccharide and/or another antigen, e.g., Vi. In addition, a nucleic acid can encode a combination of two or more such polypeptides, fragments, or variants.

Nucleic acid expression constructs can be prepared by using standard recombinant DNA methods. Regulatory elements can be included in a construct to facilitate expression of the nucleic acid encoding the polypeptide. These elements include sequences for enhancing expression in human or other mammalian cells, e.g., promoters, RNA stabilization sequences 5' and/or 3' to the coding sequence, introns (which can be placed at any location within or adjacent to the encoded sequence), and poly(A) addition sites, as well as an origin of replication and one or more genes encoding selectable markers enabling the constructs to replicate and be selected in prokaryotic and/or eukaryotic hosts. A T7 polymerase promoter or other type of promoter (e.g., a tissue-specific promoter or a cell-specific promoter such as a muscle-specific promoter) is optionally present at the 5' end of the coding sequence, and a sequence encoding a FLAG or other mAb determinant is optionally present at the 3' end of the coding sequence. The construct may also contain other transcriptional and translational signals, such as a Kozak sequence.

The construct may in addition include a sequence encoding a targeting signal that directs the encoded polypeptide to a desired intracellular compartment, the targeting signal being linked to the polypeptide. Targeting signals can direct the encoded polypeptide to endoplasmic reticulum (ER), the golgi, the nucleus, a lysosome, a class II peptide loading compartment, or an endosome, and include signal peptides, ER retention peptides, and lysosome-targeting peptides.

The nucleic acids can be used in any vector that allows for expression in cells of a mammal. The vector can be, e.g., a non-viral vector such as a plasmid or bacterial vector, an integrating viral vector, or a non-integrating viral vector. An example of a suitable vector is the family of pcDNA mammalian expression vectors (Invitrogen), which permit direct and rapid cloning of PCR products.

Various delivery systems can be used to deliver nucleic acids encoding polypeptides into appropriate cells. The nucleic acids encoding the polypeptides can be delivered in a pharmaceutically acceptable carrier such as saline, or as colloidal suspensions, or as powders, with or without diluents. The nucleic acids can be "naked" or associated with delivery vehicles and delivered using delivery systems known in the art, such as lipids, liposomes, microspheres, microparticles or microcapsules, gold particles, ISCOMS, nanoparticles, polymers, condensing agents, polysaccharides, polyamino acids, dendrimers, saponins, QS21, adsorption enhancing materials, adjuvants, or fatty acids. Nucleic acids can also be delivered to a cell, e.g., a skeletal muscle cell, either in vitro or in vivo, using electroporation.

The nucleic acids can be administered using standard methods, e.g., those described in Donnelly et al., J. Immunol Methods 176:145, 1994, and Vitiello et al., J. Clin. Invest. 95:341, 1995, and can be delivered into subjects in any manner known in the art, e.g., orally intramuscularly, intraveneously, intraarterially, intrathecally, intradermally, intraperitoneally, intranasally, intrapulmonarily, intraocularly, intravaginally, intrarectally or subcutaneously. They can be introduced into the gastrointestinal tract or the respiratory tract, e.g., by inhalation of a solution or powder containing the nucleic acids. Administration can be local or systemic.

It is expected that a dosage of approximately 100-2000 µg of nucleic acid would be administered to an individual. Where the patient is an adult human, vaccination regimens can include, e.g., intramuscular, intradermal, inhalation, or subcutaneous administrations of 10-1000 µg of a plasmid DNA when delivered in a microparticle, or of about 10-2500 µg, e.g., 100 to 2000, or 500 to 1000 µg, of naked plasmid DNA delivered intramuscularly or intradermally, repeated 3-6 times. As is well known in the medical arts, dosage for any given patient depends upon many factors, including the patient's size, general health, sex, body surface area, age, the particular compound to be administered, time and route of administration, and other drugs being administered concurrently. Determination of optimal dosage is well within the abilities of a pharmacologist of ordinary skill.

Other standard delivery methods, e.g., biolistic transfer or ex vivo treatment, can also be used. In ex vivo treatment, antigen presenting cells (APCs) such as dendritic cells, peripheral blood mononuclear cells, or bone marrow cells can be obtained from a patient or an appropriate donor and activated ex vivo with the nucleic acid, and then implanted or reinfused into the patient.

The nucleic acids can be administered alone or in combination with other therapies known in the art, e.g., antimicrobial agents. In addition, the nucleic acids can be administered in combination with other treatments designed to enhance immune responses, e.g., by co-administration with adjuvants, cytokines (or nucleic acids encoding cytokines), or CpG oligonucleotides, as is well known in the art.

The ability of a nucleic acid to elicit an immune response in a host mammal can be assayed by using methods for measuring immune responses that are well known in the art. For example, the generation of cytotoxic T cells can be demonstrated in a standard $.^{51}Cr$ release assay, by measuring intracellular cytokine expression or secretion, or by using MHC tetramers. Standard assays, such as ELISA or ELISPOT, can be used to measure cytokine profiles attributable to T cell activation. T cell proliferation can be measured using assays such as $.^{3}H$-thymidine uptake and other assays known in the art. B cell responses can be measured using art recognized assays such as ELISA. Other methodologies can also be used to evaluate the effects of the nucleic acids on pathogen-associated lesions or on other pathogen levels generally (e.g., pneumococci clearance in challenged mice treated with the conjugate).

The nucleic acids described herein can be used in the manufacture of a medicament for the prevention or treatment of an infection with *S. pneumoniae* or conditions associated with such infection.

Assays for T Cell Activation

In some embodiments, various assays can be utilized in order to characterize an antigen or composition and/or to determine whether an immune response has been stimulated in a T cell or group of T cells. In some embodiments, assays are used to characterize a T cell response in a subject that has been administered an immunogenic composition to elicit an anti-pneumococcal response (e.g., to evaluate whether a detectable T cell response has been elicited and/or to evaluate the potency of the response). The novel pneumococcal antigens described herein also provide diagnostic agents to evaluate exposure to pneumococcal infections (e.g., in non-vaccinated subjects). In some embodiments, assays are used to characterize a T cell response in a subject to determine whether the subject has been infected with a pneumococcal organism. The subject can be a subject suspected of exposure to a pneumococcal organism recently (i.e., an assay to detect a response can be performed with a sample taken from the subject about 3, 4, 5, 6, 7, 8, 9, 10, 14, 30, or more days after suspected exposure to apneumococcalorganism). The subject can be a subject suspected of exposure to a pneumococcal organism weeks, months, or years prior to the assay. The novel pneumococcal antigens described herein also provide prognostic agents to evaluate outcomes of exposure to a pneumococcal organism (e.g., in subjects known to be, or to have been, infected with a pneumococcal organism). In some embodiments, assays are used to characterize a T cell response in a subject to assess the likelihood of sequelae (e.g., sepsis) to infection with a pneumococcal organism.

In some embodiments, stimulation of an immune response in T cells is determined by measuring antigen-induced production of cytokines by T cells. In some embodiments, stimulation of an immune response in T cells can be determined by measuring antigen-induced production of IFN-γ, IL-4, IL-2, IL-6, IL-10, IL-17 and/or TNF-α by T cells. In some embodiments, antigen-induced production of cytokines by T cells can be measured by intracellular cytokine staining followed by flow cytometry. Other suitable methods include surface capture staining followed by flow cytometry, or methods that determine cytokine concentration in supernatants of activated T cell cultures, such as ELISA or ELISPOT assays.

In some embodiments, antigen-produced production of cytokines by T cells is measured by ELISPOT assay. ELISPOT assays typically employ a technique very similar to the sandwich enzyme-linked immunosorbent assay (ELISA) technique. An antibody (e.g. monoclonal antibody, polyclonal antibody, etc.) is coated aseptically onto a PVDF (polyvinylidene fluoride)-backed microplate. Antibodies are chosen for their specificity for the cytokine of interest. The plate is blocked (e.g., with a serum protein that is non-reactive with any of the antibodies in the assay). Cells to be tested for cytokine production are plated out at varying densities, along with antigen or mitogen, and then placed in a humidified 37° C. $CO_2$ incubator for a specified period of time. Cytokine secreted by activated cells is captured locally by the coated antibody on the high surface area PVDF membrane. After washing the wells to remove cells, debris, and media components, a secondary antibody (e.g. a biotinylated polyclonal antibody) specific for the cytokine is added to the wells. This antibody is reactive with a distinct epitope of the target cytokine and thus is employed to detect the captured cytokine. Following a wash to remove any unbound biotinylated antibody, the detected cytokine is then visualized using an avidin-HRP, and a precipitating substrate (e.g., AEC, BCIP/NBT). The colored end product (a spot, usually red or blue) typically represents an individual cytokine-producing cell. Spots can be counted manually (e.g., with a dissecting microscope) or using an automated reader to capture the microwell images and to analyze spot number and size. In some embodiments, each spot correlates to a single cytokine-producing cell.

In some embodiments, an immune response in T cells is said to be stimulated if between about 1% and about 100% of antigen-specific T cells produce cytokines. In some embodiments, an immune response in T cells is said to be stimulated if at least about 1%, at least about 5%, at least about 10%, at least about 25%, at least about 50%, at least about 75%, at least about 90%, at least about 95%, at least about 99%, or about 100% of antigen-specific T cells produce cytokines.

In some embodiments, an immune response in T cells is said to be stimulated if immunized subjects comprise at least about 10-fold, at least about 50-fold, at least about 100-fold, at least about 500-fold, at least about 1000-fold, at least about 5000-fold, at least about 10.000-fold, at least about 50.000-fold, at least about 100.000-fold, or greater than at least about 100.000-fold more cytokine-producing cells than do naive controls.

In some embodiments, stimulation of an immune response in T cells can be determined by measuring antigen-induced proliferation of T cells. In some embodiments, antigen-induced proliferation may be measured as uptake of $H_3$-thymidine in dividing T cells (sometimes referred to as "lymphocyte transformation test, or "LTT"). In some embodiments, antigen-induced proliferation is said to have occurred if $^3H$-thymidine uptake (given as number of counts from a γ. counter) is at least about 5-fold, at least about 10-fold, at least about 20-fold, at least about 50-fold, at least about 100-fold, at least about 500-fold, at least about 1000-fold, at least about 5000-fold, at least about 10.000-fold, or greater than at least about 10.000-fold higher than a naive control.

In some embodiments, antigen-induced proliferation may be measured by flow cytometry. In some embodiments, antigen-induced proliferation may be measured by a carboxyfluorescein succinimidyl ester (CFSE) dilution assay. CFSE is a non-toxic, fluorescent, membrane-permeating dye that binds the amino groups of cytoplasmic proteins with its succinimidyl-reactive group (e.g., T cell proteins). When cells divide, CFSE-labeled proteins are equally distributed between the daughter cells, thus halving cell fluorescence with each division. Consequently, antigen-specific T cells lose their fluorescence after culture in the presence of the respective antigen ($CFSE^{low}$) and are distinguishable from other cells in culture ($CFSE^{high}$). In some embodiments, antigen-induced proliferation is said to have occurred if CFSE dilution (given as the percentage of $CFSE^{low}$ cells out of all CFSE cells) is at least about 5%, at least about 10%, at least about 25%, at least about 50%, at least about 75%, at least about 90%, at least about 95%, or at least about 100%.

In some embodiments, an immune response in T-cells is said to be stimulated if cellular markers of T cell activation are expressed at different levels (e.g., higher or lower levels) relative to unstimulated cells. In some embodiments, CD11a, CD27, CD25, CD40L, CD44, CD45RO, and/or CD69 are more highly expressed in activated T cells than in unstimulated T cells. In some embodiments, L-selectin (CD62L), CD45RA, and/or CCR7 are less highly expressed in activated T cells than in unstimulated T cells.

In some embodiments, an immune response in T cells is measured by assaying cytotoxicity by effector CD8+ T cells against antigen-pulsed target cells. For example, a $^{51}$chromium ($^{51}$Cr) release assay can be performed. In this assay, effector CD8+ T cells bind infected cells presenting virus peptide on class I MHC and signal the infected cells to undergo apoptosis. If the cells are labeled with $^{51}$Cr before the effector CD8+ T cells are added, the amount of $^{51}$Cr released into the supernatant is proportional to the number of targets killed. In some embodiments, an immune response in T cells is measured by an in vivo cytotoxicity assay in which target cells are antigen pulsed and labeled with a fluorescent dye, then transferred into immunized animals. Specific cytolytic T cells cause the disappearance of fluorescently labeled cells that are pulsed with a relevant antigen, but no decrease in cells pulsed with a control antigen. See, e.g., Coligan et al., Current Protocols in Immunology, 3.11.14-16, John Wiley & Sons, Inc., 2007. In some embodiments, an immune response in T cells is measured by detecting expression of one or more of Perforin, Granzyme B, or CD107a (e.g., by ELISPOT or flow cytometry). See, e.g., Betts et al., J. Immunol Meth. 281(1-2):65-78, 2003.

In Vivo Assays

In some embodiments, an immunogenic composition may be characterized (e.g., to assess efficacy in inducing a beneficial response in animal models) by infecting groups of immunized and non-immunized mice (e.g., 3 or more weeks after vaccination) with a dose of a chlamydia organism that typically produces a particular pathology (e.g., upper urogenital tract infection) or bacterial burden. The magnitude and duration of pathology or bacterial burden due to infection of both groups is monitored and compared. In one example, B cell responses are characterized by transferring serum from immune mice as a "passive vaccine" to assess protection of non-immune mice from pathological effects or burden of infection. In some embodiments, infiltrating leukocyte populations are characterized (e.g., to assess the number and type cells in a region of infection, e.g., whether CD4.sup.+ T cells, CD8.sup.+ T cells, or other cell types are present). Animal models for chlamydial urogenital infection have been described. In some embodiments, a chlamydia organism is applied as an intravaginal inoculum, and infection and pathology of one or more of lower and upper genital tracts of the infected animal is characterized. See, e.g., Barron et al. (J. Infect. Dis. 143(1):63-6, 1981), which describes an intravaginal infection model in mice. In some embodiments, clearance of primary infection is a measure of protective immunity in this model. In some embodiments, detection of CD4+ T cell responses of a Th1 subtype correlate with protection (Morrison et al., Infect Immun 70:2741-2751, 2002).

In some embodiments, an immunogenic composition is assessed in an animal model of pneumococcal infection. In some embodiments, lower urogenital tract infection by pneumococcus is assessed in the model (e.g., lower tract bacterial burden and/or inflammation due to infection is assessed). In some embodiments, upper tract infection by chlamydia is assessed in the model (e.g., one or more of upper tract bacterial burden, inflammation, infertility, collagen deposition, scarring due to infection, are assessed). In some embodiments, an ability to prevent ascension of a chlamydia infection from the lower tract to the upper genital tract is assessed. In some embodiments, rate of bacterial clearance from the lower tract is assessed. In some embodiments, rate of bacterial clearance from the upper tract is assessed. In some embodiment, the rate of bacterial clearance from the nose is assessed. In some embodiments, an immunogenic composition is assessed in an animal model in multiple strains of the animal of interest (e.g., multiple mouse strains). In some embodiments, presence and size of hydrosalpinx (fluid blockage of fallopian tubes) is assessed.

In some embodiments, desirable immunogenic compositions are characterized as having one or more of the above effects in vivo (e.g., in an animal model). For example, in some embodiments, an immunogenic composition reduces lower urogenital tract infection by chlamydia bacteria. In some embodiments, an immunogenic composition reduces lower tract bacterial burden. In some embodiments, an immunogenic composition reduces lower tract inflammation due to infection. In some embodiments, an immunogenic composition reduces upper tract infection by pneumococcus. In some embodiments, an immunogenic composition reduces ascension of a pneumococcal infection from the lower tract to the upper genital tract. In some embodiments, an immunogenic composition increases the rate of bacterial clearance from the lower tract and/or the upper tract. In some embodiments, an immunogenic composition has one or more of the above effects in multiple animal strains (e.g., multiple mouse strains).

In some embodiments, pneumococcal antigens of Table 1 or functional fragments thereof for use in the immunogenic compositions as disclosed herein elicits an IL-17A response in mouse splenocytes or human PBMCs in vitro as disclosed in Example 2, and/or protects colonization in vivo in a mouse colonization model, where mice are challenged with a serotype of pneumococcal strain (e.g., serotypes 6B, 14F or 19F) after biweekly immunization with a pneumococcal antigen (or functional fragment), and assessing for presence of pneumococcal colonization in the nose, as disclosed in Example 3.

One of ordinary skill in the art will recognize that the assays described above are only exemplary methods which could be utilized in order to determine whether T cell activation and/or B cell activation has occurred. Any assay known to one of skill in the art which can be used to determine whether T and/or B cell activation has occurred falls within the scope of this invention. The assays described herein as well as additional assays that could be used to determine whether T and/or B cell activation has occurred are described in Current Protocols in Immunology (John Wiley & Sons, Hoboken, N. Y., 2007; incorporated herein by reference).

Ongoing studies assess immunogenicity in outbred animal strains, and characterize the efficacy of these proteins in protecting against invasive disease in aspiration/sepsis models. In some embodiments, one can test the ability of a pneumococcal antigen, e.g., an antigen listed in Table 1, or a homologue or functional fragment or variant of an antigen listed in Table 1 to elicit an immune response in vivo, by measuring a CMI response to the target antigen. CMI assays are known in the art and described, for example, in United States Patent Application 2005/0014205, WO/1987/005400, U.S. Pat. No. 5,674,698 and commercially available kits such as IMMUNKNOW® CYLEX Immune cell function assay Product No. 4400, which are incorporated in their entirety by reference herein for use in the present invention.

Applications and Use of the Immunogenic Compositions

The S. pneumoniae vaccines described herein may be used for prophylactic and/or therapeutic treatment of S.

*pneumoniae*. Accordingly, this application provides a method for treating a subject suffering from or susceptible to *S. pneumoniae* infection, comprising administering an effective amount of any of the vaccine formulations described herein. In some aspects, the method inhibits *S. pneumoniae* colonization in an individual. In some aspects, the method inhibits *S. pneumoniae* symptoms or sequelae, such as sepsis. The subject receiving the vaccination may be a male or a female, and may be a child or adult. In some embodiments, the subject being treated is a human. In other embodiments, the subject is a non-human animal.

Accordingly, the immunogenic compositions and methods described herein can be used for the prophylaxis and/or treatment of any pneumococcal infection, pneumococcal disease, disorder, and/or condition, or a pneumococcal infection, such as sepsis. As used herein, "prophylaxis" refers to uses before onset of symptoms due to a pneumococcal infection, pneumococcal disease, disorder, and/or condition and/or before known exposure to a *Streptococcus pneumoniae* organism. Subjects include, but are not limited to, humans and/or other primates; and other animals susceptible to infection by *S. pneumoniae* organisms, including commercially relevant mammals such as cattle, pigs, horses, sheep, cats, and/or dogs; and/or birds, including commercially relevant birds such as chickens, ducks, geese, and/or turkeys.

1. Prophylactic Use

In prophylactic embodiments, a vaccine or immunogenic composition as disclosed herein is administered to a subject to induce an immune response that can help protect against the establishment of *S. pneumoniae*, for example by protecting against colonization, the first and necessary step in disease. Thus, in some aspects, the method inhibits infection by *S. pneumoniae* in a non-colonized or uninfected subject. In another aspect, the method may reduce the duration of colonization in an individual who is already colonized.

In some embodiments, a vaccine or immunogenic composition as disclosed herein confer protective immunity, allowing a vaccinated individual to exhibit delayed onset of symptoms or sequelae, or reduced severity of symptoms or sequelae, as the result of his or her exposure to the vaccine. In certain embodiments, the reduction in severity of symptoms or sequelae is at least 25%, 40%, 50%, 60%, 70%, 80% or even 90%. In particular embodiments, vaccinated individuals may display no symptoms or sequelae upon contact with *S. pneumoniae*, do not become colonized by *S. pneumoniae*, or both. Protective immunity is typically achieved by one or more of the following mechanisms: mucosal, humoral, or cellular immunity Mucosal immunity is primarily the result of secretory IgA (sIGA) antibodies on mucosal surfaces of the respiratory, gastrointestinal, and genitourinary tracts. The sIGA antibodies are generated after a series of events mediated by antigen-processing cells, B and T lymphocytes, that result in sIGA production by B lymphocytes on mucosa-lined tissues of the body. Humoral immunity is typically the result of IgG antibodies and IgM antibodies in serum. Cellular immunity can be achieved through cytotoxic T lymphocytes or through delayed-type hypersensitivity that involves macrophages and T lymphocytes, as well as other mechanisms involving T cells without a requirement for antibodies. In particular, cellular immunity may be mediated by TH1 or TH17 cells.

Essentially any individual has a certain risk of becoming infected with *S. pneumoniae*. However, certain sub-populations have an increased risk of infection. In some embodiments, a vaccine formulation as described herein (e.g., a composition comprising one or more polypeptides from Table 1 or 2, or nucleic acids encoding the polypeptides, or antibodies reactive with the polypeptides) is administered to patients that are immunocompromised.

An immunocompromising condition arising from a medical treatment is likely to expose the individual in question to a higher risk of infection with *S. pneumoniae*. It is possible to treat an infection prophylactically in an individual having the immunocompromised condition before or during treatments known to compromise immune function. By prophylactically treating with an antigenic composition (e.g., two or more antigens from Table 1 or 2, or nucleic acids encoding the antigens), or with antibodies reactive to two or more antigens from Table 1 or 2, before or during a treatment known to compromise immune function, it is possible to prevent a subsequent *S. pneumoniae* infection or to reduce the risk of the individual contracting an infection due to the immunocompromised condition. Should the individual contract an *S. pneumoniae* infection e.g., following a treatment leading to an immunocompromised condition it is also possible to treat the infection by administering to the individual an antigen composition.

The following groups are at increased risk of pneumococcal disease or its complications, and therefore it is advantageous for subjects falling into one or more of these groups to receive a vaccine formulation described herein: children, especially those from 1 month to 5 years old or 2 months to 2 years old; children who are at least 2 years of age with asplenia, splenic dysfunction or sickle-cell disease; children who are at least 2 years of age with nephrotic syndrome, chronic cerebrospinal fluid leak, HIV infection or other conditions associated with immunosuppression.

In another embodiment, at least one dose of the pneumococcal antigen composition is given to adults in the following groups at increased risk of pneumococcal disease or its complications: all persons 65 years of age; adults with asplenia, subjects with Job's syndrome (subject lacking Th-17 cell-mediated response), subjects with aggamaglobunemia (a subject lacking antibody-mediated response), splenic dysfunction or sickle-cell disease; adults with the following conditions: chronic cardiorespiratory disease, cirrhosis, alcoholism, chronic renal disease, nephrotic syndrome, diabetes mellitus, chronic cerebrospinal fluid leak, HIV infection, AIDS and other conditions associated with immunosuppression (Hodgkin's disease, lymphoma, multiple myeloma, immunosuppression for organ transplantation), individuals with cochlear implants; individuals with long-term health problems such as heart disease and lung disease, as well as individuals who are taking any drug or treatment that lowers the body's resistance to infection, such as long-term steroids, certain cancer drugs, radiation therapy; Alaskan natives and certain Native American populations.

2. Therapeutic Use

In therapeutic applications, a vaccine or immunogenic composition as disclosed herein may be administered to a patient suffering from *S. pneumoniae* infection, in an amount sufficient to treat the patient. Treating the patient, in this case, refers to reducing *S. pneumoniae* symptoms and/or bacterial load and/or sequelae bin an infected individual. In some embodiments, treating the patient refers to reducing the duration of symptoms or sequelae, or reducing the intensity of symptoms or sequelae. In some embodiments, the vaccine reduces transmissibility of *S. pneumoniae* from the vaccinated patient. In certain embodiments, the reductions described above are at least 25%, 30%, 40%, 50%, 60%, 70%, 80% or even 90%.

In therapeutic embodiments, the vaccine is administered to an individual post-infection. The vaccine may be administered shortly after infection, e.g. before symptoms or sequelae manifest, or may be administered during or after manifestation of symptoms or sequelae.

A therapeutic *S. pneumoniae* vaccine can reduce the intensity and/or duration of the various symptoms or sequelae of *S. pneumoniae* infection. Symptoms or sequelae of *S. pneumoniae* infection can take many forms. Invasive pneumococcal diseases include acute sinusitis, otitis media, meningitis, bacteremia, sepsis, osteomyelitis, septic arthritis, endocarditis, peritonitis, pericarditis, cellulitis, and brain abscess. Accordingly, in some cases, an infected patient develops pneumonia, acute sinusitis, otitis media (ear infection), meningitis, bacteremia, sepsis, osteomyelitis, septic arthritis, endocarditis, peritonitis, pericarditis, cellulitis, or brain abscess.

Sepsis is a rare but life-threatening complication of *S. pneumoniae* infection, where the bacterium invades the bloodstream and systemic inflammation results. Typically, fever is observed and white blood cell count increases. A further description of sepsis is found in Goldstein, B. et al. "International pediatric sepsis consensus conference: definitions for sepsis and organ dysfunction in pediatrics." Pediatr Crit. Care Med. January 2005; 6 (1):2-8.

In some embodiments, immunogenic compositions in accordance with the present invention may be used to treat, alleviate, ameliorate, relieve, delay onset of, inhibit progression of, reduce risk of infection by, and reduce severity of, and/or reduce incidence of one or more symptoms or features of a pneumococcal disease, disorder, and/or condition. In some embodiments, inventive an immunogenic composition may be used to treat, alleviate, ameliorate, relieve, delay onset of, inhibit progression of, reduce severity of, and/or reduce incidence of one or more symptoms or features of pneumococcal infection (e.g., but not limited to sepsis, pneumonia, acute otitis media, bacteremia and bacterial meningitis).

In one aspect of the invention, a method for the prophylaxis and/or treatment of pneumococcal infection is provided. In some embodiments, the prophylaxis and/or treatment of pneumococcal infection comprises administering a therapeutically effective amount of an immunogenic composition described herein to a subject in need thereof, in such amounts and for such time as is necessary to achieve the desired result. In certain embodiments of the present invention a "therapeutically effective amount" of an inventive immunogenic composition is that amount effective for reducing risk of infection by, or treating, alleviating, ameliorating, relieving, delaying onset of, inhibiting progression of, reducing severity of, and/or reducing incidence of one or more symptoms or features of pneumococcal infection. A therapeutically effective amount may be determined on a population basis, and is not required to be an amount that naturally induces a protective response in a particular subject.

In some embodiments, inventive prophylactic and/or therapeutic protocols involve administering a therapeutically effective amount of one or more inventive immunogenic compositions to a healthy subject (i.e., a subject who does not display any symptoms of chlamydia infection and/or who has not been diagnosed with pneumococcal infection). For example, healthy individuals may be vaccinated using inventive immunogenic compositions prior to development of pneumococcal infection and/or onset of symptoms of pneumococcal infection; at risk individuals (e.g., patients exposed to individuals suffering from pneumococcal infection, patients with HIV or a compromised immune system, or a subject who is susceptible is to pneumococcal infection such as a subject with Job's syndrome (subject lacking Th-17 cell-mediated response) or a subject with aggamaglobunemic (a subject lacking antibody-mediated response)) can be treated substantially contemporaneously with (e.g., within 48 hours, within 24 hours, or within 12 hours of) the onset of symptoms of and/or exposure to pneumococcal infection. Of course individuals known to have pneumococcal infection or sepsis may receive treatment at any time.

In some embodiments, inventive prophylactic and/or therapeutic protocols involve administering a therapeutically effective amount of one or more inventive immunogenic compositions to a subject such that an immune response is stimulated in both T cells and B cells.

In some embodiments, by combining one or more pneumococcal antigens and adjuvants, immune responses (e.g. T cell and/or B cell responses) can be tailored to preferentially elicit the most desirable type of immune response for a given indication, e.g., humoral response, Th1 T cell response, Th17 T cell response, IFN-γ secretion by antigen-specific T cells, cytotoxic T cell response, antibody response, B cell response, innate immune response, or a combination of these responses.

Assaying Vaccination Efficacy

The efficacy of vaccination with the a vaccine or immunogenic composition as disclosed herein may be determined in a number of ways, in addition to the clinical outcomes described above. First, one may assay IL-17 levels (particularly IL-17A) by stimulating T cells derived from the subject after vaccination. The IL-17 levels may be compared to IL-17 levels in the same subject before vaccination. Increased IL-17 (e.g., IL-17A) levels, such as a 1.5 fold, 2-fold, 5-fold, 10-fold, 20-fold, 50-fold or 100-fold or more increase, would indicate an increased response to the vaccine. Alternatively (or in combination), one may assay neutrophils in the presence of T cells or antibodies from the patient for pneumococcal killing. Increased pneumococcal killing, such as a 1.5 fold, 2-fold, 5-fold, 10-fold, 20-fold, 50-fold or 100-fold or more increase, would indicate an increased response to the vaccine. In addition, one may measure T.sub.H17 cell activation, where increased T.sub.H17 cell activation, such as a 1.5 fold, 2-fold, 5-fold, 10-fold, 20-fold, 50-fold or 100-fold or more increase, correlates with an increased response to the vaccine. One may also measure levels of an antibody specific to the vaccine, where increased levels of the specific antibody, such as a 1.5 fold, 2-fold, 5-fold, 10-fold, 20-fold, 50-fold or 100-fold or more increase, are correlated with increased vaccine efficacy. In certain embodiments, two or more of these assays are used. For example, one may measure IL-17 levels and the levels of vaccine-specific antibody. Alternatively, one may follow epidemiological markers such as incidence of, severity of, or duration of pneumococcal infection in vaccinated individuals compared to unvaccinated individuals.

Vaccine efficacy may also be assayed in various model systems such as the mouse model. For instance, BALB/c or C57BL/6 strains of mice may be used. After administering the test vaccine to a subject (as a single dose or multiple doses), the experimenter administers a challenge dose of *S. pneumoniae*. In some cases, a challenge dose administered intranasally is sufficient to cause *S. pneumoniae* colonization (especially nasal colonization) in an unvaccinated animal, and in some cases a challenge dose administered via aspiration is sufficient to cause sepsis and a high rate of lethality in unvaccinated animals. One can then measure the reduction in colonization or the reduction in lethality in vaccinated animals. As demonstrated in Examples 1-3, the efficacy of polypeptides of Table 1 in inhibiting S. pneumoniae nasal colonization following intranasal challenge in the mouse model can be assessed. Examples 3 and 4 show the efficacy of polypeptides of Table 1 in protecting against sepsis and death following infection with S. pneumoniae via aspiration in the mouse model.

Immunogenic Compositions and Formulations

In one embodiment, an immunogenic composition as disclosed herein, e.g., a vaccine or immunogenic composition described herein, can comprise a pharmaceutically acceptable carrier. In another embodiment, the vaccine composition described herein is formulated for administering to a mammal. Suitable formulations can be found in Remington's Pharmaceutical Sciences, 16th and 18th Eds., Mack Publishing, Easton, Pa. (1980 and 1990), and Introduction to Pharmaceutical Dosage Forms, 4th Edition, Lea & Febiger, Philadelphia (1985), each of which is incorporated herein by reference.

In one embodiment, a vaccine compositions as described herein comprise pharmaceutically acceptable carriers that are inherently nontoxic and nontherapeutic. Examples of such carriers include ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts, or electrolytes such as protamine sulfate, disodium hydrogen phosphate, potassium hydrogen phosphate, sodium chloride, zinc salts, colloidal silica, magnesium trisilicate, polyvinyl pyrrolidone, cellulose-based substances, and polyethylene glycol. For all administrations, conventional depot forms are suitably used. Such forms include, for example, microcapsules, nano-capsules, liposomes, plasters, inhalation forms, nose sprays, sublingual tablets, and sustained release preparations. For examples of sustained release compositions, see U.S. Pat. Nos. 3,773,919, 3,887,699, EP 58,481A, EP 158,277A, Canadian Patent No. 1176565; U. Sidman et al., Biopolymers 22:547 (1983) and R. Langer et al., Chem. Tech. 12:98 (1982). The proteins will usually be formulated at a concentration of about 0.1 mg/ml to 100 mg/ml per application per patient.

In one embodiment, other ingredients can be added to vaccine formulations, including antioxidants, e.g., ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, mannose, or dextrins; chelating agents such as EDTA; and sugar alcohols such as mannitol or sorbitol.

In one embodiment, a vaccine composition as described herein for administration must be sterile. Sterility is readily accomplished by filtration through sterile filtration membranes (e.g., 0.2 micron membranes).

In some embodiments, a vaccine composition as described herein further comprises pharmaceutical excipients including, but not limited to biocompatible oils, physiological saline solutions, preservatives, carbohydrate, protein, amino acids, osmotic pressure controlling agents, carrier gases, pH-controlling agents, organic solvents, hydrophobic agents, enzyme inhibitors, water absorbing polymers, surfactants, absorption promoters and anti-oxidative agents. Representative examples of carbohydrates include soluble sugars such as hydropropyl cellulose, carboxymethyl cellulose, sodium carboxyl cellulose, hyaluronic acid, chitosan, alginate, glucose, xylose, galactose, fructose, maltose, saccharose, dextran, chondroitin sulfate, etc. Representative examples of proteins include albumin, gelatin, etc. Representative examples of amino acids include glycine, alanine, glutamic acid, arginine, lysine, and their salts.

In some embodiments, the immunogens as described herein can be solubilized in water, a solvent such as methanol, or a buffer. Suitable buffers include, but are not limited to, phosphate buffered saline $Ca^{2+}/Mg^{2+}$ free (PBS), normal saline (150 mM NaCl in water), and Tris buffer. Antigen not soluble in neutral buffer can be solubilized in 10 mM acetic acid and then diluted to the desired volume with a neutral buffer such as PBS. In the case of antigen soluble only at acid pH, acetate-PBS at acid pH may be used as a diluent after solubilization in dilute acetic acid. Glycerol can be a suitable non-aqueous buffer for use in the present invention.

If the immunogen as disclosed herein is not soluble per se, the immunogen can be present in the formulation in a suspension or even as an aggregate. In some embodiments, hydrophobic antigen can be solubilized in a detergent, for example a polypeptide containing a membrane-spanning domain. Furthermore, for formulations containing liposomes, an antigen in a detergent solution (e.g., a cell membrane extract) may be mixed with lipids, and liposomes then may be formed by removal of the detergent by dilution, dialysis, or column chromatography.

In some embodiments, a vaccine composition is administered in combination with other therapeutic ingredients including, e.g., γ-interferon, cytokines, chemotherapeutic agents, or anti-inflammatory or anti-viral agents.

In some embodiments, a vaccine composition is administered in a pure or substantially pure form, but it is preferable to present it as a pharmaceutical composition, formulation or preparation. Such formulation comprises polypeptides described herein together with one or more pharmaceutically acceptable carriers and optionally other therapeutic ingredients. Other therapeutic ingredients include compounds that enhance antigen presentation, e.g., gamma interferon, cytokines, chemotherapeutic agents, or anti-inflammatory agents. The formulations can conveniently be presented in unit dosage form and may be prepared by methods well known in the pharmaceutical art. For example, Plotkin and Mortimer (In 'Vaccines', 1994, W.B. Saunders Company; 2nd edition) describes vaccination of animals or humans to induce an immune response specific for particular pathogens, as well as methods of preparing antigen, determining a suitable dose of antigen, and assaying for induction of an immune response.

In some embodiments, a vaccine composition as described herein further comprises an adjuvant, as described herein.

Formulations of vaccine compositions suitable for intravenous, intramuscular, intranasal, oral, subcutaneous, or intraperitoneal administration conveniently comprise sterile aqueous solutions of the active ingredient with solutions which are preferably isotonic with the blood of the recipient. Such formulations may be conveniently prepared by dissolving solid active ingredient in water containing physiologically compatible substances such as sodium chloride (e.g., 0.1-2.0 M), glycine, and the like, and having a buffered pH compatible with physiological conditions to produce an aqueous solution, and rendering the solution sterile. These may be present in unit or multi-dose containers, for example, sealed ampoules or vials.

Liposomal suspensions can also be used as pharmaceutically acceptable carriers. These can be prepared according to methods known to those skilled in the art, for example, as described in U.S. Pat. No. 4,522,811.

Formulations for an intranasal delivery are described in U.S. Pat. Nos. 5,427,782, 5,843,451 and 6,398,774, which are incorporated herein in their entirety by reference. Other means of mucosal administration are also encompassed herein.

The formulations of a vaccine composition as disclosed herein can also incorporate a stabilizer. Illustrative stabilizers are polyethylene glycol, proteins, saccharide, amino acids, inorganic acids, and organic acids which may be used either on their own or as admixtures. Two or more stabilizers may be used in aqueous solutions at the appropriate concentration and/or pH. The specific osmotic pressure in such aqueous solution is generally in the range of 0.1-3.0 osmoses, preferably in the range of 0.80-1.2. The pH of the aqueous solution is adjusted to be within the range of 5.0-9.0, preferably within the range of 6-8.

When oral preparations are desired, a vaccine composition can be combined with typical carriers, such as lactose, sucrose, starch, talc magnesium stearate, crystalline cellulose, methyl cellulose, carboxymethyl cellulose, glycerin, sodium alginate or gum arabic among others.

The present invention provides immunogenic compositions (e.g., vaccines) comprising a novel pneumococcal antigen, e.g., one or more of a polypeptide antigen selected from Table 1 or functional fragments thereof and any combinations thereof, and one or more pharmaceutically acceptable excipients. In accordance with some embodiments, a method of administering an inventive immunogenic composition to a subject in need thereof is provided. In some embodiments, inventive compositions are administered to humans. For the purposes of the present invention, the phrase "active ingredient" generally refers to an inventive immunogenic composition comprising at least one chlamydia antigen and optionally comprising one or more additional agents, such as an adjuvant.

Although the descriptions of immunogenic compositions provided herein are principally directed to compositions which are suitable for administration to humans, it will be understood by the skilled artisan that such compositions are generally suitable for administration to animals of all sorts. Modification of immunogenic compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the immunogenic compositions of the invention is contemplated include, but are not limited to, humans and/or other primates; mammals, including commercially relevant mammals such as domestic animals, cattle, pigs, horses, sheep, cats, and/or dogs; and/or birds, including commercially relevant birds such as chickens, ducks, geese, and/or turkeys.

The formulations of the immunogenic compositions described herein may be prepared by any method known or hereafter developed in the art of vaccines. In some embodiments, such preparatory methods include the step of bringing the antigen(s) (or nucleic acids encoding the antigens, for nucleic acid based applications) into association with one or more excipients and/or one or more other accessory ingredients, and then, if necessary and/or desirable, shaping and/or packaging the product into a desired single- or multi-dose unit.

An immunogenic composition of the invention may be prepared, packaged, and/or sold in bulk, as a single unit dose, and/or as a plurality of single unit doses. As used herein, a "unit dose" is discrete amount of the immunogenic composition comprising a predetermined amount of the antigen(s).

The relative amounts of the antigen(s), the pharmaceutically acceptable excipient(s), and/or any additional ingredients (e.g., adjuvant) in a composition of the invention will vary, depending upon the identity, size, and/or condition of the subject treated and further depending upon the route by which the composition is to be administered.

Immunogenic formulations of the present invention may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21.sup.st Edition, A. R. Gennaro, (Lippincott, Williams & Wilkins, Baltimore, Md., 2006; incorporated herein by reference) discloses various excipients used in formulating pharmaceutical compositions and known techniques for the preparation thereof. Except insofar as any conventional excipient is incompatible with a substance or its derivatives, such as by producing any undesirable biological effect or otherwise interacting in a deleterious manner with any other component(s) of the immunogenic composition, its use is contemplated to be within the scope of this invention.

In some embodiments, the pharmaceutically acceptable excipient is at least 95%, 96%, 97%, 98%, 99%, or 100% pure. In some embodiments, the excipient is approved for use in humans and for veterinary use. In some embodiments, the excipient is approved by United States Food and Drug Administration. In some embodiments, the excipient is pharmaceutical grade. In some embodiments, the excipient meets the standards of the United States Pharmacopoeia (USP), the European Pharmacopoeia (EP), the British Pharmacopoeia, and/or the International Pharmacopoeia.

Pharmaceutically acceptable excipients used in the manufacture of immunogenic compositions include, but are not limited to, inert diluents, dispersing and/or granulating agents, surface active agents and/or emulsifiers, disintegrating agents, binding agents, preservatives, buffering agents, lubricating agents, and/or oils. Such excipients may optionally be included in the inventive formulations.

Injectable formulations, for example, sterile injectable aqueous or oleaginous suspensions may be formulated according to the known art using suitable dispersing or wetting agents and suspending agents. A sterile injectable preparation may be a sterile injectable solution, suspension or emulsion in a nontoxic parenterally acceptable diluent or solvent, for example, as a solution in 1,3-butanediol. Among the acceptable vehicles and solvents that may be employed are water, Ringer's solution, U.S.P. and isotonic sodium chloride solution. In addition, sterile, fixed oils are conventionally employed as a solvent or suspending medium. For this purpose any bland fixed oil can be employed including synthetic mono- or diglycerides. In addition, fatty acids such as oleic acid are used in the preparation of injectables.

Injectable formulations can be sterilized, for example, by filtration through a bacterial-retaining filter, or by incorporating sterilizing agents in the form of sterile solid compositions which can be dissolved or dispersed in sterile water or other sterile injectable medium prior to use.

In order to prolong release of an immunogenic composition and stimulate maximal uptake by antigen presenting cells in the vicinity of an injection site, it is often desirable to slow the absorption from subcutaneous or intramuscular injection. This may be accomplished by the use of a liquid suspension of crystalline or amorphous material with poor water solubility. Alternatively, delayed absorption of a parenterally administered drug form may be accomplished by dissolving or suspending the drug in an oil vehicle.

In some embodiments, an immunogenic composition is administered to a mucosal surface. Compositions for rectal or vaginal administration can include suppositories which can be prepared by mixing immunogenic compositions of this invention with suitable excipients such as cocoa butter, polyethylene glycol or a suppository wax, which are solid at ambient temperature but liquid at body temperature and therefore melt in the rectum or vaginal cavity and release antigen.

In some embodiments, an immunogenic composition is administered orally. Solid dosage forms for oral administration include capsules, tablets, pills, powders, and granules. In such solid dosage forms, the antigen can be mixed with at least one inert, pharmaceutically acceptable excipient such as sodium citrate or dicalcium phosphate and/or a) fillers or extenders such as starches, lactose, sucrose, glucose, mannitol, and silicic acid, b) binders such as, for example, carboxymethylcellulose, alginates, gelatin, polyvinylpyrrolidinone, sucrose, and *acacia, c*) humectants such as glycerol, d) disintegrating agents such as agar, calcium carbonate, potato or tapioca starch, alginic acid, certain silicates, and sodium carbonate, e) solution retarding agents such as paraffin, f) absorption accelerators such as quaternary ammonium compounds, g) wetting agents such as, for example, cetyl alcohol and glycerol monostearate, h) absorbents such as kaolin and bentonite clay, and i) lubricants such as talc, calcium stearate, magnesium stearate, solid polyethylene glycols, sodium lauryl sulfate, and mixtures thereof. In the case of capsules, tablets and pills, the dosage form may comprise buffering agents.

Suitable devices for use in delivering immunogenic compositions by an intradermal route described herein include short needle devices such as those described in U.S. Pat. Nos. 4,886,499; 5,190,521; 5,328,483; 5,527,288; 4,270,537; 5,015,235; 5,141,496; and 5,417,662. Jet injection devices which deliver liquid immunogenic compositions to the dermis via a liquid jet injector and/or via a needle which pierces the stratum corneum and produces a jet which reaches the dermis are suitable. Jet injection devices are described, for example, in U.S. Pat. Nos. 5,480,381; 5,599,302; 5,334,144; 5,993,412; 5,649,912; 5,569,189; 5,704,911; 5,383,851; 5,893,397; 5,466,220; 5,339,163; 5,312,335; 5,503,627; 5,064,413; 5,520,639; 4,596,556; 4,790,824; 4,941,880; 4,940,460; and PCT publications WO 97/37705 and WO 97/13537. Ballistic powder/particle delivery devices which use compressed gas to accelerate an immunogenic composition in powder form through the outer layers of the skin to the dermis are suitable. Alternatively or additionally, conventional syringes may be used in the classical mantoux method of intradermal administration.

General considerations in the formulation and/or manufacture of pharmaceutical agents may be found, for example, in Remington: The Science and Practice of Pharmacy 21.sup.st ed., Lippincott Williams & Wilkins, 2005.

The vaccine formulation or immunogenic composition may be suitable for administration to a human patient, and vaccine or immunogenic composition preparation may conform to USFDA guidelines. In some embodiments, the vaccine formulation or immunogenic composition is suitable for administration to a non-human animal. In some embodiments, the vaccine or immunogenic composition is substantially free of either endotoxins or exotoxins. Endotoxins may include pyrogens, such as lipopolysaccharide (LPS) molecules. The vaccine or immunogenic composition may also be substantially free of inactive protein fragments which may cause a fever or other side effects. In some embodiments, the composition contains less than 1%, less than 0.1%, less than 0.01%, less than 0.001%, or less than 0.0001% of endotoxins, exotoxins, and/or inactive protein fragments. In some embodiments, the vaccine or immunogenic composition has lower levels of pyrogens than industrial water, tap water, or distilled water. Other vaccine or immunogenic composition components may be purified using methods known in the art, such as ion-exchange chromatography, ultrafiltration, or distillation. In other embodiments, the pyrogens may be inactivated or destroyed prior to administration to a patient. Raw materials for vaccines, such as water, buffers, salts and other chemicals may also be screened and depyrogenated. All materials in the vaccine may be sterile, and each lot of the vaccine may be tested for sterility. Thus, in certain embodiments the endotoxin levels in the vaccine fall below the levels set by the USFDA, for example 0.2 endotoxin (EU)/kg of product for an intrathecal injectable composition; 5 EU/kg of product for a non-intrathecal injectable composition, and 0.25-0.5 EU/mL for sterile water.

In certain embodiments, the preparation comprises less than 50%, 20%, 10%, or 5% (by dry weight) contaminating protein. In certain embodiments, the desired molecule is present in the substantial absence of other biological macromolecules, such as other proteins (particularly other proteins which may substantially mask, diminish, confuse or alter the characteristics of the component proteins either as purified preparations or in their function in the subject reconstituted mixture). In certain embodiments, at least 80%, 90%, 95%, 99%, or 99.8% (by dry weight) of biological macromolecules of the same type present (but water, buffers, and other small molecules, especially molecules having a molecular weight of less than 5000, can be present). In some embodiments, the vaccine or immunogenic composition comprising purified subunit proteins contains less than 5%, 2%, 1%, 0.5%, 0.2%, 0.1% of protein from host cells in which the subunit proteins were expressed, relative to the amount of purified subunit. In some embodiments, the desired polypeptides are substantially free of nucleic acids and/or carbohydrates. For instance, in some embodiments, the vaccine or immunogenic composition contains less than 5%, less than 2%, less than 1%, less than 0.5%, less than 0.2%, or less than 0.1% host cell DNA and/or RNA. In certain embodiments, at least 80%, 90%, 95%, 99%, or 99.8% (by dry weight) of biological macromolecules of the same type are present in the preparation (but water, buffers, and other small molecules, especially molecules having a molecular weight of less than 5000, can be present).

It is preferred that the vaccine or immunogenic composition has low or no toxicity, within a reasonable risk-benefit ratio. In certain embodiments, the vaccine or immunogenic composition comprises ingredients at concentrations that are less than LD.50 measurements for the animal being vaccinated. LD50 measurements may be obtained in mice or other experimental model systems, and extrapolated to humans and other animals. Methods for estimating the LD50 of compounds in humans and other animals are well-known in the art. A vaccine formulation or immunogenic composition, and any component within it, might have an LD50 value in rats of greater than 100 g/kg, greater than 50 g/kg, greater than 20 g/kg, greater than 10 g/kg, greater than 5 g/kg, greater than 2 g/kg, greater than 1 g/kg, greater than 500 mg/kg, greater than 200 mg/kg, greater than 100 mg/kg, greater than 50 mg/kg, greater than 20 mg/kg, or greater than 10 mg/kg. A vaccine formulation or immunogenic composition that comprises a toxin such as botulinum toxin (which can be used as an adjuvant) should contain significantly less than the LD50 of botulinum toxin.

The formulations suitable for introduction of the vaccine formulations or pharmaceutical composition vary according to route of administration. Formulations suitable for parenteral administration, such as, for example, by intraarticular (in the joints), intravenous, intramuscular, intradermal, intraperitoneal, intranasal, and subcutaneous routes, include aqueous and non-aqueous, isotonic sterile injection solutions, which can contain antioxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The formulations can be presented in unit-dose or multi-dose sealed containers, such as ampoules and vials.

Injection solutions and suspensions can be prepared from sterile powders, granules, and tablets of the kind previously described. In the case of adoptive transfer of therapeutic T cells, the cells can be administered intravenously or parenterally.

Formulations suitable for oral administration can consist of (a) liquid solutions, such as an effective amount of the polypeptides or packaged nucleic acids suspended in diluents, such as water, saline or PEG 400; (b) capsules, sachets or tablets, each containing a predetermined amount of the active ingredient, as liquids, solids, granules or gelatin; (c) suspensions in an appropriate liquid; and (d) suitable emulsions. Tablet forms can include one or more of lactose, sucrose, mannitol, sorbitol, calcium phosphates, corn starch, potato starch, tragacanth, microcrystalline cellulose, acacia, gelatin, colloidal silicon dioxide, croscarmellose sodium, talc, magnesium stearate, stearic acid, and other excipients, colorants, fillers, binders, diluents, buffering agents, moistening agents, preservatives, flavoring agents, dyes, disintegrating agents, and pharmaceutically compatible carriers. Lozenge forms can comprise the active ingredient in a flavor, usually sucrose and acacia or tragacanth, as well as pastilles comprising the active ingredient in an inert base, such as gelatin and glycerin or sucrose and acacia emulsions, gels, and the like containing, in addition to the active ingredient, carriers known in the art. The pharmaceutical compositions can be encapsulated, e.g., in liposomes, or in a formulation that provides for slow release of the active ingredient.

The antigens, alone or in combination with other suitable components, can be made into aerosol formulations (e.g., they can be "nebulized") to be administered via inhalation. Aerosol formulations can be placed into pressurized acceptable propellants, such as dichlorodifluoromethane, propane, nitrogen, and the like. Aerosol formulations can be delivered orally or nasally.

Suitable formulations for vaginal or rectal administration include, for example, suppositories, which consist of the polypeptides or packaged nucleic acids with a suppository base. Suitable suppository bases include natural or synthetic triglycerides or paraffin hydrocarbons. In addition, it is also possible to use gelatin rectal capsules which consist of a combination of the polypeptides or packaged nucleic acids with a base, including, for example, liquid triglycerides, polyethylene glycols, and paraffin hydrocarbons.

Doses and Routes of Administration

1. Dosage Forms, Amounts, and Timing

The amount of antigen in each vaccine or immunogenic composition dose is selected as an effective amount, which induces a prophylactic or therapeutic response, as described above, in either a single dose or over multiple doses. Preferably, the dose is without significant adverse side effects in typical vaccines. Such amount will vary depending upon which specific antigen is employed. Generally, it is expected that a dose will comprise 1-1000 µg of each protein, in some instances 2-100 µg, for instance 4-40 µg. In some aspects, the vaccine formulation comprises 1-1000 µg of the polypeptide and 1-250 µg of the adjuvant. In some embodiments, the appropriate amount of antigen to be delivered will depend on the age, weight, and health (e g immunocompromised status) of a subject. When present, typically an adjuvant will be present in amounts from 1 µg-250 µg per dose, for example 50-150 µg, 75-125 µg or 100 µg.

In some embodiments, only one dose of the vaccine is administered to achieve the results described above. In other embodiments, following an initial vaccination, subjects receive one or more boost vaccinations, for a total of two, three, four or five vaccinations. Advantageously, the number is three or fewer. A boost vaccination may be administered, for example, about 1 month, 2 months, 4 months, 6 months, or 12 months after the initial vaccination, such that one vaccination regimen involves administration at 0, 0.5-2 and 4-8 months. It may be advantageous to administer split doses of vaccines which may be administered by the same or different routes.

The vaccines and immunogenic compositions described herein may take on a variety of dosage forms. In certain embodiments, the composition is provided in solid or powdered (e.g., lyophilized) form; it also may be provided in solution form. In certain embodiments, a dosage form is provided as a dose of lyophilized composition and at least one separate sterile container of diluent.

In some embodiments, the composition will be administered in a dose escalation manner, such that successive administrations of the composition contain a higher concentration of composition than previous administrations. In some embodiments, the composition will be administered in a manner such that successive administrations of the composition contain a lower concentration of composition than previous administrations.

The precise dose to be employed in the formulation will also depend on the route of administration and should be decided according to the judgment of the practitioner and each patient's circumstances. For example, a range of 25 µg-900 µg total immunogen protein can be administered intradermally, monthly for 3 months. Ultimately, the attending physician will decide the amount of protein or vaccine composition to administer to particular individuals.

In some embodiments, a therapeutically effective amount of an inventive immunogenic composition is delivered to a patient and/or animal prior to, simultaneously with, and/or after exposure to a chlamydia organism or diagnosis with a chlamydial disease, disorder, and/or condition. In some embodiments, a therapeutic amount of an inventive composition is delivered to a patient and/or animal prior to, simultaneously with, and/or after onset of symptoms of a chlamydial disease, disorder, and/or condition. In some embodiments, the amount of an immunogenic composition is sufficient to reduce risk of infection by, or treat, alleviate, ameliorate, relieve, delay onset of, inhibit progression of, reduce severity of, and/or reduce incidence of one or more symptoms or features of the chlamydial disease, disorder, and/or condition.

Immunogenic compositions, according to the method of the present invention, may be administered using any amount and any route of administration effective for treatment. The exact amount required will vary from subject to subject, depending on the species, age, and general condition of the subject, the severity of the infection, the particular composition, its mode of administration, its mode of activity, and the like. The specific effective dose level for any particular subject or organism will depend upon a variety of factors including the immunogenicity of the antigen composition employed; the specific composition employed; the nature of adjuvant used; the age, body weight, general health, sex and diet of the subject; the time of administration, route of administration, and like factors well known in the medical arts.

In therapeutic applications, compositions are administered to a patient suffering from a disease in an amount sufficient to treat the patient. Therapeutic applications of a composition described herein include reducing transmissibility, slowing disease progression, reducing bacterial viability or replication, or inhibiting the expression of proteins required for toxicity, such as by 90%, 80%, 70%, 60%, 50%, 40%, 30%, 20% or 10% of the levels at which they would occur in individuals who are not treated with the composition.

In prophylactic embodiments, compositions are administered to a human or other mammal to induce an immune response that can inhibit the establishment of an infectious disease or other condition. In some embodiments, a composition may partially block the bacterium from establishing an infection.

In some embodiments, the compositions are administered in combination with antibiotics. This co-administration is particularly appropriate when the pharmaceutical composition is administered to a patient who has recently been exposed (or is suspected of having been recently exposed) to *S. pneumoniae*. Many antibiotics are used to treat pneumococcal infections, including penicillin, amoxicillin, amoxicillin/clavulanate, cefuroxime, cefotaxime, ceftriaxone, and vancomycin. The appropriate antibiotic may be selected based on the type and severity of the infection, as well as any known antibiotic resistance of the infection (Jacobs M R "Drug-resistant *Streptococcus pneumoniae*: rational antibiotic choices" Am J. Med. 1999 May 3; 106 (5A):19S-25S).
2. Administration A method of immunization or vaccinating a mammal against pneumococcal infections comprises administering a vaccine composition described herein.

In some embodiments, the immunogenic compositions or vaccine compositions as described herein can be administered intravenously, intranasally, intramuscularly, subcutaneously, infraperitoneally or orally. A preferred route of administration is intranasal or by other mucosal route.

Vaccination can be conducted by conventional methods. For example, an immunogen as polypeptide as disclosed in Table 1 can be used in a suitable diluent such as saline or water, and optionally with complete or incomplete adjuvants. The vaccine can be administered by any route appropriate for eliciting an immune response. The vaccine can be administered once or at periodic intervals until an immune response is elicited Immune responses can be detected by a variety of methods known to those skilled in the art, including but not limited to, antibody production, cytotoxicity assay, proliferation assay and cytokine release assays. For example, samples of blood can be drawn from the immunized mammal, and analyzed for the presence of antibodies against the immunogen protein used in the vaccination by ELISA and the titer of these antibodies can be determined by methods known in the art.

Immunogenic compositions of the present invention may be administered by any route that elicits an immune response. In some embodiments, an immunogenic composition is administered subcutaneously. In some embodiments, an immunogenic composition is administered intramuscularly. In some embodiments, the immunogenic compositions of the present invention are administered by a variety of routes, including oral, intravenous, intra-arterial, intramedullary, intrathecal, intraventricular, transdermal, interdermal, rectal, intravaginal, intraperitoneal, topical (as by powders, ointments, creams, and/or drops), transdermal, mucosal, nasal, buccal, enteral, sublingual; by intratracheal instillation, bronchial instillation, and/or inhalation; and/or as an oral spray, nasal spray, and/or aerosol.

The vaccine formulations and pharmaceutical compositions herein can be delivered by administration to an individual, typically by systemic administration (e.g., intravenous, intraperitoneal, intramuscular, intradermal, subcutaneous, subdermal, transdermal, intracranial, intranasal, mucosal, anal, vaginal, oral, buccal route or they can be inhaled) or they can be administered by topical application. In some embodiments, the route of administration is intramuscular. In other embodiments, the route of administration is subcutaneous. In yet other embodiments, the route of administration is mucosal. In certain embodiments, the route of administration is transdermal or intradermal Certain routes of administration are particularly appropriate for vaccine formulations and immunogenic compositions comprising specified adjuvants. In particular, transdermal administration is one suitable route of administration for *S. pneumoniae* vaccines comprising toxins (e.g. cholera toxin or labile toxin); in other embodiments, the administration is intranasal. Vaccines formulated with Alphavirus replicons may be administered, for example, by the intramuscular or the subcutaneous route. Vaccines comprising Monophosphory Lipid A (MPL), Trehalose Dicoynomycolate (TDM), and dioctadecyldimethylammonium bromide (DDA) are suitable (inter alia) for intramuscular and subcutaneous administration. A vaccine comprising resiquimod may be administered topically or subcutaneously, for example.

In certain embodiments, an immunogenic composition of the invention may be administered in amounts that include a protein antigen in ranges of 1 µg-500 µg. In some embodiments, a dose of about 10 µg, 20, 30 µg, 50 µg, or 100 µg is administered to a human.

In some embodiments, an immunogenic composition is administered more than once (e.g., twice, three times, four times, five times). In some embodiments, a boost is given about one week, two weeks, three weeks, one month, three months, six months, one year, or longer after an initial immunization.

Preparation and Storage of Vaccine Formulations and Immunogenic Compositions

The *S. pneumoniae* vaccines and immunogenic compositions described herein may be produced using a variety of techniques. For example, a polypeptide may be produced using recombinant DNA technology in a suitable host cell. A suitable host cell may be bacterial, yeast, mammalian, or other type of cell. The host cell may be modified to express an exogenous copy of one of the relevant polypeptide genes. Typically, the gene is operably linked to appropriate regulatory sequences such as a strong promoter and a polyadenylation sequence. In some embodiments, the promoter is inducible or repressible. Other regulatory sequences may provide for secretion or excretion of the polypeptide of interest or retention of the polypeptide of interest in the cytoplasm or in the membrane, depending on how one wishes to purify the polypeptide. The gene may be present on an extrachromosomal plasmid, or may be integrated into the host genome. One of skill in the art will recognize that it is not necessary to use a nucleic acid 100% identical to the naturally-occurring sequence. Rather, some alterations to these sequences are tolerated and may be desirable. For instance, the nucleic acid may be altered to take advantage of the degeneracy of the genetic code such that the encoded polypeptide remains the same. In some embodiments, the gene is codon-optimized to improve expression in a particular host. The nucleic acid may be produced, for example, by PCR or by chemical synthesis.

Once a recombinant cell line has been produced, a polypeptide may be isolated from it. The isolation may be accomplished, for example, by affinity purification techniques or by physical separation techniques (e.g., a size column).

In a further aspect of the present disclosure, there is provided a method of manufacture comprising mixing one or more polypeptides or an immunogenic fragment or variant thereof with a carrier and/or an adjuvant.

In some embodiments, antigens for inclusion the vaccine formulations and immunogenic compositions may be produced in cell culture. One method comprises providing one or more expression vectors and cloning nucleotides encoding one or more polypeptides selected from polypeptides having an amino acid sequence of Table 1, such as SEQ ID NO: 1-76 or 153-234, then expressing and isolating the polypeptides.

The immunogenic polypeptides described herein, and nucleic acid compositions that express the polypeptides, can be packaged in packs, dispenser devices, and kits for administering nucleic acid compositions to a mammal. For example, packs or dispenser devices that contain one or more unit dosage forms are provided. Typically, instructions for administration of the compounds will be provided with the packaging, along with a suitable indication on the label that the compound is suitable for treatment of an indicated condition, such as those disclosed herein.

Use of Immunogenic Compositions
1. Defense Against *S. pneumoniae* Infection

The immunogenic compositions of the present disclosure are designed to elicit an immune response against *S. pneumoniae*. Compositions described herein (e.g., ones comprising one or more polypeptides of Table 1 or 2, or nucleic acids encoding the polypeptides) may stimulate an antibody response or a cell-mediated immune response, or both, in the mammal to which it is administered. In some embodiments, the composition stimulates a TH1-biased CD4+ T cell response, a TH17-biased CD4+ T cell response and/or a CD8+ T cell response. In some embodiments, the composition stimulates an antibody response. In some embodiments, the composition stimulates a TH1-biased CD4+ T cell response, TH17-biased CD4+ T cell response and/or a CD8+ T cell response, and an antibody response.

In certain embodiments, the composition (e.g., one comprising one or more polypeptides of Table 1 or 2, or nucleic acids encoding the polypeptides, or antibodies reactive with the peptides) includes a cytokine or nucleotide coding region encoding a cytokine such as IL-17, to provide additional stimulation to the immune system of the mammal. In certain embodiments, the composition comprises a cytokine such as IL-17.

While not wishing to be bound by theory, in some embodiments a T.sub.H17 cell response is desirable in mounting an immune response to the compositions disclosed herein, e.g., ones comprising one or more polypeptides of Table 1 or 2. In certain embodiments, an active T.sub.H17 response is beneficial in clearing a pneumococcal infection. For instance, mice lacking the IL-17A receptor show decreased whole cell vaccine-based protection from a pneumococcal challenge (Lu et al., "Interleukin-17A mediates acquired immunity to pneumococcal colonization." PLoS Pathog. 2008 Sep. 19; 4 (9)).

Thus, herein is provided a method of increasing IL-17 production by administering the compositions described herein (e.g., ones comprising one or more polypeptides of Table 1 or 2) to a subject. Furthermore, this application provides a method of activating T.sub.H17 cells by administering said compositions to a subject. In certain embodiments, increased IL-17A levels result in increased pneumococcal killing by neutrophils or neutrophil-like cells, for instance by inducing recruitment and activation of neutrophils of neutrophil-like cells. In certain embodiments, this pneumococcal killing is independent of antibodies and complement. However, specific antibody production and complement activation may be useful additional mechanisms that contribute to clearing of a pneumococcal infection.

Immunogenic compositions containing immunogenic polypeptides or polynucleotides encoding immunogenic polypeptides together with a pharmaceutical carrier are also provided.

In some instances, the immunogenic composition comprises one or more nucleic acids encoding one or more polypeptides of SEQ ID NOS: 1-76, such as one or more nucleic acids selected from SEQ ID Nos. 77-152. In some embodiments these nucleic acids are expressed in the immunized individual, producing the encoded *S. pneumoniae* antigens, and the *S. pneumoniae* antigens so produced can produce an immunostimulatory effect in the immunized individual.

Such a nucleic acid-containing immunostimulatory composition may comprise, for example, an origin of replication, and a promoter that drives expression of one or more nucleic acids encoding one or more polypeptides of SEQ ID NOS: 1-76. Such a composition may also comprise a bacterial plasmid vector into which is inserted a promoter (sometimes a strong viral promoter), one or more nucleic acids encoding one or more polypeptides of SEQ ID NOS: 1-76, and a polyadenylation/transcriptional termination sequence. In some instances, the nucleic acid is DNA.

Diagnostic Uses

This application provides, inter alia, a rapid, inexpensive, sensitive, and specific method for detection of *S. pneumoniae* in patients. In this respect it should be useful to all hospitals and physicians examining and treating patients with or at risk for *S. pneumoniae* infection. Detection kits can be simple enough to be set up in any local hospital laboratory, and the antibodies and antigen-binding portions thereof can readily be made available to all hospitals treating patients with or at risk for *S. pneumoniae* infection. As used herein, "patient" refers to an individual (such as a human) that either has an *S. pneumoniae* infection or has the potential to contract an *S. pneumoniae* infection. A patient may be an individual (such as a human) that has an *S. pneumoniae* infection, has the potential to contract an *S. pneumoniae* infection, who has recovered from *S. pneumoniae* infection, and/or an individual whose infection status is unknown.

In some embodiments, one may perform a diagnostic assay using two or more antibodies, each of which binds one of the antigens of Table 1 detect *S. pneumoniae* in an individual. As disclosed in Example 5, sera from a mouse immunized with SP0785 detected the presence to type 4 TIGR4 *S. pneumoniae* strain. Accordingly, in some embodiment, one of the antigens for use in a diagnostic is any pneumococcal antigen selected from SEQ ID NO: 1-76. The instant disclosure also provides a method of phenotyping biological samples from patients suspected of having a *S. pneumoniae* infection: (a) obtaining a biological sample from a patient; (b) contacting the sample with two or more *S. pneumoniae*-specific antibodies or antigen-binding portions thereof under conditions that allow for binding of the antibody or antigen-binding portion to an epitope of *S. pneumoniae*; where binding indicates the presence of *S. pneumoniae* in the sample. In some embodiments, the binding to the biological sample is compared to binding of the same antibody to a negative control tissue, wherein if the biological sample shows the presence of *S. pneumoniae* as compared to the negative control tissue, the patient is identified as likely having a *S. pneumoniae* infection. In some cases, binding of one antibody indicates the presence of *S. pneumoniae*; in other cases, the binding of two or more antibodies indicates the presence of *S. pneumoniae*. The aforementioned test may be appropriately adjusted to detect other bacterial infections, for instance by using an antibody immunoreactive a homolog (from another bacterial species) of one of the proteins described in Table 1. In some embodiments, the antibodies raised against a *S. pneumoniae* protein in Table 1 will also bind the homolog in another *Streptococcus* species, especially if the homologs have a high percentage sequence identity.

Alternatively, one may use an antigen of Table 1 (such as SEQ ID NO: 1-76) to detect anti-*S. pneumoniae* antibodies in an individual. The instant disclosure also provides a method of phenotyping biological samples from patients suspected of having a *S. pneumoniae* infection: (a) obtaining a biological sample from a patient; (b) contacting the sample with two or more *S. pneumoniae*-specific antigens selected from Table 1 or portions or functional fragments thereof under conditions that allow for binding of the antigen (or portion thereof) to any host antibodies present in the sample; where binding indicates the presence of anti-*S. pneumoniae* antibodies in the sample. In some embodiments, the binding to the biological sample is compared to binding of the same antigen to a negative control tissue, wherein if the biological sample shows the presence of anti-*S. pneumoniae* antibodies as compared to the negative control tissue, the patient is identified as likely either (1) having a *S. pneumoniae* infection, or (2) having had a *S. pneumoniae* infection in the past. In some cases, detecting one antibody indicates a current or past infection with *S. pneumoniae*; in other cases, detecting two or more antibodies indicates a current or past infection with *S. pneumoniae*. The aforementioned test may be appropriately adjusted to detect other bacterial infections, for instance by using a homolog (from another bacterial species (e.g., a Streptococcal species) of the proteins described in Table 1.

In some embodiments, the immune cell response of a mammalian cell may be quantified ex vivo. A method for such quantification comprises administering the compositions herein disclosed to a mammalian T cell ex vivo, and quantifying the change in cytokine production of the mammalian T cell in response to the composition. In these methods, the cytokine may be, for example, IL-17.

The binding of an *S. pneumoniae* antibody to an antigen (e.g., a polypeptide of Table 1, such as SEQ ID NO: 1-76) may be measured using any appropriate method. Such methods include ELISA (enzyme-linked immunosorbent assay), Western blotting, competition assay, and spot-blot. The detection step may be, for instance, chemiluminescent, fluorescent, or colorimetric. One suitable method for measuring antibody-protein binding is the Luminex xMAP system, where peptides are bound to a dye-containing microsphere. Certain systems, including the xMAP system, are amenable to measuring several different markers in multiplex, and could be used to measure levels of antibodies at once. In some embodiments, other systems are used to assay a plurality of markers in multiplex. For example, profiling may be performed using any of the following systems: antigen microarrays, bead microarrays, nanobarcodes particle technology, arrayed proteins from cDNA expression libraries, protein in situ array, protein arrays of living transformants, universal protein array, lab-on-a-chip microfluidics, and peptides on pins. Another type of clinical assay is a chemiluminescent assay to detect antibody binding. In some such assays, including the VITROS Eci anti-HCV assay, antibodies are bound to a solid-phase support made up of microparticles in liquid suspension, and a surface fluorometer is used to quantify the enzymatic generation of a fluorescent product.

In some embodiments, if the biological sample shows the presence of *S. pneumoniae* (e.g., by detecting one or more polypeptide of Table 1, such as SEQ ID NO: 1-76, or an antibody that binds one of said polypeptides), one may administer a therapeutically effective amount of the compositions and therapies described herein to the patient. The biological sample may comprise, for example, blood, semen, urine, vaginal fluid, mucus, saliva, feces, urine, cerebrospinal fluid, or a tissue sample. In some embodiments, the biological sample is an organ intended for transplantation. In certain embodiments, before the detection step, the biological sample is subject to culture conditions that promote the growth of *S. pneumoniae*.

The diagnostic tests herein (e.g., those that detect a polypeptide of Table 1, such as SEQ ID NO: 1-76, or an antibody that binds one of said polypeptides) may be used to detect *S. pneumoniae* in a variety of samples, including samples taken from patients and samples obtained from other sources. For example, the diagnostic tests may be used to detect *S. pneumoniae* in food, drink, or ingredients for food and drink; on objects such as medical instruments, medical devices such as cochlear implants and pacemakers, shoes, clothing, furniture including hospital furniture, and drapes including hospital drapes; or in samples taken from the environment such as plant samples. In some embodiments, the tests herein may be performed on samples taken from animals such as agricultural animals (cows, pigs, chickens, goats, horses and the like), companion animals (dogs, cats, birds, and the like), or wild animals. In certain embodiments, the tests herein may be performed on samples taken from cell cultures such as cultures of human cells that produce a therapeutic protein, cultures of bacteria intended to produce a useful biological molecule, or cultures of cells grown for research purposes.

This disclosure also provides a method of determining the location of a *S. pneumoniae* infection in a patient comprising: (a) administering a pharmaceutical composition comprising a labeled *S. pneumoniae* antibody or antigen-binding portion thereof to the patient, and (b) detecting the label, wherein binding indicates a *S. pneumoniae* infection in a particular location in the patient. Such a diagnostic may also comprise comparing the levels of binding in the patient to a control. In certain embodiments, the method further comprises, if the patient has a *S. pneumoniae* infection, treating the infection by administering a therapeutically effective amount of a *S. pneumoniae*-binding antibody or antigen-binding portion thereof to the patient. In certain embodiments, the method further comprises, if the patient has a *S. pneumoniae* infection, treating the infection by administering a therapeutically effective amount of a *S. pneumoniae* protein of Table 1 or 2, or immunogenic portion thereof, to the patient. The method may further comprise determining the location and/or volume of the *S. pneumoniae* in the patient. This method may be used to evaluate the spread of *S. pneumoniae* in the patient and determine whether a localized therapy is appropriate.

In some embodiments, the anti-*S. pneumoniae* antibodies or T cells described herein may be used to make a prognosis of the course of infection. In some embodiments, the anti-*S. pneumoniae* antibodies or T cells herein may be detected in a sample taken from a patient. If antibodies or T cells are present at normal levels, it would indicate that the patient has raised an immune response against anti-*S. pneumoniae*. If antibodies or T cells are absent, or present at reduced levels, it would indicate that the patient is failing to raise a sufficient response against anti-*S. pneumoniae*, and a more aggressive treatment would be recommended. In some embodiments, antibodies or T cells present at reduced levels refers to antibodies that are present at less than 50%, 20%, 10%, 5%, 2%, or 1% the level of antibodies or T cells typical in a patient with a normal immune system. Antibodies may be detected by affinity for any of the antigens described herein (e.g., those in Table 1 and/or 2), for example using ELISA. T cells may be detected by ex vivo responses for any of the antigens described herein (e.g., those in Table 1 and/or 2), for example using ELISA or ELISPOT assays.

In some embodiments, detection of specific *S. pneumoniae* antigens (e.g., those in Table 1 and/or 2, such as SEQ ID NO: 1-76 and/or SEQ ID NO: 153-234) may be used to predict the progress and symptoms of *S. pneumoniae* infection in a patient. It will be understood by one of skill in the art that the methods herein are not limited to detection of *S. pneumoniae*. Other embodiments include the detection of related bacteria including bacteria with proteins homologous to the proteins described in Table 1 or 2. Such related bacteria include, for example, other strains of *Streptococcus*. Accordingly, in some embodiments, such pneumococcal antigen proteins of Table 1 or immunogen mixtures may be useful in diagnostics.

Kits

Another aspect of the present invention provides a variety of kits comprising one or more of the pneumococcal antigens as described herein. For example, the invention provides a kit including a novel pneumococcal antigen and instructions for use. A kit may include multiple different pneumococcal antigens. A kit may include any of a number of additional components or reagents in any combination. All of the various combinations are not set forth explicitly but each combination is included in the scope of the invention.

According to certain embodiments of the invention, a kit may include, for example, (i) an immunogenic composition including at least one of the following chlamydia antigens: SP0785, SP1500, SP0346, SP1386, SP0084, SP1479 and SP2145 polypeptide antigens; and (ii) instructions for administering the composition to a subject in need thereof. In some embodiments, the kit further includes an adjuvant.

Kits that include nucleic acids encoding chlamydia antigens are also provided. In certain embodiments, a kit may include, for example, (i) a composition including a nucleic acid encoding a pneumococcal antigen; (ii) instructions for use of the nucleic acid compositing (e.g., instructions for expressing the nucleic acid for producing the antigen, or instructions for administering the composition to a subject in need thereof to elicit a response against pneumococcus).

Instructions included with kits may, for example, include protocols and/or describe conditions for production of immunogenic compositions and/or administration of immunogenic compositions, to a subject in need thereof, etc. Kits generally include one or more vessels or containers so that some or all of the individual components and reagents may be separately housed. Kits may also include a means for enclosing individual containers in relatively close confinement for commercial sale, e.g., a plastic box, in which instructions, packaging materials such as styrofoam, etc., may be enclosed. An identifier, e.g., a bar code, radio frequency identification (ID) tag, etc., may be present in or on the kit or in or one or more of the vessels or containers included in the kit. An identifier can be used, e.g., to uniquely identify the kit for purposes of quality control, inventory control, tracking, movement between workstations, etc.

Some embodiments of the technology described herein can be defined according to any of the following numbered paragraphs:

1. An immunogenic composition comprising at least one isolated pneumococcal antigen or fragment thereof with the amino acid sequence selected from SEQ ID NO: 1-76 or SEQ ID NO: 153-234, and wherein the composition elicits an immune response against *Streptococcus pneumoniae* when administered to a mammal.
2. The immunogenic composition of paragraph 1, wherein the pneumococcal antigen or fragment thereof exists as a fusion conjugate.
3. The immunogenic composition of paragraph 2, wherein the fusion conjugate is a polysaccharide conjugate.
4. The immunogenic composition of paragraph 3, wherein the fusion conjugate comprises the pneumococcal antigen or fragment thereof fused to a pneumococcal pneumolysoid PdT, wherein the pneumococcal pneumolysoid PdT is conjugated to the polysaccharide.
5. The immunogenic composition of any of paragraphs 2 to 4, wherein the polysaccharide is dextran, Vi polysaccharide of *Salmonella typhi*, or pneumococcal cell wall polysaccharide (CWPS), or another polysaccharide of prokaryotic or eukaryotic origin.
6. The immunogenic composition of any of paragraphs 1 to 5, wherein the immunogenic composition induces a IL-17A (Th17-cell) response in a subject.
7. The immunogenic composition of any of paragraphs 1 to 6, wherein the immunogenic composition is further prepared as a vaccine that reduces or protects a mammal against pneumococcal colonization.
8. The immunogenic composition of any of paragraphs 1 to 7, wherein the immunogenic composition further comprises an adjuvant.
9. The immunogenic composition of any of paragraphs 1 to 8, wherein said immunogenic composition is administered mucosally.
10. The immunogenic composition of any of paragraphs 1 to 9, wherein the immunogenic composition comprises at least 2 pneumococcal antigens or fragments with the amino acid sequence selected from SEQ ID NO: 1-76 or SEQ ID NO: 153-234.

11. The immunogenic composition of any of paragraphs 1 to 10, wherein the immunogenic composition comprises at least 3 pneumococcal antigens or fragments with the amino acid sequence selected from SEQ ID NO: 1-76 or SEQ ID NO: 153-234.

12. The immunogenic composition of any of paragraphs 1 to 11, wherein the immunogenic composition comprises at least 5 pneumococcal antigens or fragments with the amino acid sequence selected from SEQ ID NO: 1-76 or SEQ ID NO: 153-234.

13. The immunogenic composition of any of paragraphs 1 to 12, wherein the immunogenic composition comprises between 5 and 20 pneumococcal antigens or fragments thereof with the amino acid sequence selected from SEQ ID NO: 1-76 or SEQ ID NO: 153-234.

14. The immunogenic composition of any of paragraphs 1 to 13, wherein the immunogenic composition comprises more than 20 pneumococcal antigens or fragments thereof with the amino acid sequence selected from SEQ ID NO: 1-76 or SEQ ID NO: 153-234.

15. The method of any of paragraphs 1 to 14, wherein a pneumococcal protein or protein fragment is at least one of the pneumococcal proteins SP0785, SP1500 and SP2145.

16. The method of any of paragraphs 1 to 15, wherein the immune response comprises a humoral immune response.

17. The method of any of paragraphs 1 to 15, wherein the immune response comprises a cellular immune response.

18. A method of inducing an IL-17A response in a subject, comprising administering to the subject at least one immunogenic composition of any of paragraphs 1-17 effective to induce an immune response against *Streptococcus pneumoniae* in the subject.

19. A method to protect against pneumococcal colonization, comprising administering to the subject at least one immunogenic composition of any of paragraphs 1-17.

20. A method to elicit an immune response against *Streptococcus pneumoniae* in a mammal, the method comprising administering to the mammal at least one immunogenic composition comprising one or more isolated pneumococcal antigen or fragment thereof with the amino acid sequence selected from SEQ ID NO: 1-76 or SEQ ID NO: 153-234 in an effective to induce an immune response against *Streptococcus pneumoniae* in the subject.

21. A method to protect against *Streptococcus pneumonia* or *Salmonella typhi* colonization in a mammal, comprising administering to the mammal at least one immunogenic composition of any of paragraphs 1-17 in effective to induce an immune response against *Streptococcus pneumoniae* in the subject.

22. The method of any of paragraphs 18-21, wherein the immunogenic composition comprises at least one isolated pneumococcal antigen or fragment thereof is SP0785 or SP1500.

23. The method of paragraph 22, wherein the pneumococcal antigen or fragment thereof has an amino acid sequence selected from SEQ ID NO: 34 (SP0785) or SEQ ID NO: 51 (SP1500).

24. A method to protect against an invasive disease of *Streptococcus pneumoniae* in a subject, comprising administering to the subject an immunogenic composition of any of paragraphs 1-17 in effective to induce an immune response against *Streptococcus pneumoniae* in the subject.

25. The method of paragraph 24, wherein the invasive disease is sepsis.

26. The method of paragraph 24, wherein the immunogenic composition comprises at least one isolated pneumococcal antigen or fragment thereof is SP1386, SP1500, SP0084 and SP1479 and SP0346.

27. The method of paragraph 26, wherein the pneumococcal antigen or fragment thereof has an amino acid sequence selected from SEQ ID NO: 46 (SP1386), SEQ ID NO: 51 (SP1500), SEQ ID NO: 4 (SP0084), SEQ ID NO: 50 (SP1479) and SEQ ID NO: 15 (SP0346).

28. The method of any of paragraphs 18-27, wherein the pneumococcal antigen or fragment thereof is conjugated to the pneumococcal pneumolysoid PdT.

29. The method of any of paragraphs 18-27, wherein the pneumococcal antigen or fragment thereof is conjugated to the Vi polysaccharide of *Salmonella typhi*.

30. The method of any of paragraphs 18-29, wherein the pneumococcal antigen or fragment thereof is conjugated to the pneumococcal pneumolysoid PdT and the Vi polysaccharide of *Salmonella typhi*.

31. The method of any of paragraphs 18-30, wherein the administration is mucosal administration.

32. The method of any of paragraphs 18-31, wherein the administration is intravenous, subcutaneous or intraperitoneal (IP) administration.

33. The method of any of paragraphs 18-32, wherein the immune response comprises a humoral immune response.

34. The method of any of paragraphs 18-32, wherein the immune response comprises a cellular immune response.

EXAMPLES

Materials and Methods

Materials: Aluminum hydroxide (alum) was from Brenntag North America (2% Alhydrogel). Ni-NTA resin was purchased from Qiagen. CloneEZ PCR cloning kit was obtained from Genscript Inc. All other reagents were obtained from Sigma or Thermo Fisher Scientific.

Construction of Expression Library.

The extracellular domains of selected proteins were amplified using TIGR4 genomic DNA as template by PCR and then integrated into pET21b expression vectors using the CloneEZ PCR cloning kit. Signal and transmembrane sequences were excluded from cloning. Detailed cloning region and primer sequences are listed in table I. For proteins that are unusually large (SP0648, SP0664 and SP1154, larger than 250 kDa) and proved difficult to purify as full-length, we divided their sequence into 3 parts and purified each separately. We chose to divide the proteins based on the prediction of their secondary structure by BCL::Jufo (http://meilerlab.org/index.php/servers/show?s_id=5), making truncations in areas that are not conserved by amino acid sequence. Thus the final protein library consists of 80 proteins/peptides. Plasmid sequences were verified by Genewiz Inc.

Protein Purification.

E. coli transformants containing the relevant cloned proteins were grown to OD600=0.6, and protein expression was induced with 0.2 mM IPTG at 16° C. overnight. Cells were spun down and pellets were resuspended in lysis buffer (20 mM Tris-HCl, 500 mM NaCl, pH8.0) and then lysed by sonication. The proteins of interest were purified from supernatant over a Ni-NTA column; proteins were eluted in imidazole buffer. Protein-containing elutions were combined, purified over a gel-filtration column and eluted in PBS buffer.

Generation of the Vi Conjugates.

Vi was resuspended to 5 mg/ml in buffer A (0.2 M MES, 150 mM NaCl, pH 5.9), and 1-ethyl-3-(3-dimethylaminopropyl)carbodiimide (EDC) and NHS-Sulfo was added into solution as powder for 30 minutes at 4° C. Reaction buffer was raised to pH7.5 by addition of 1M $Na_2HPO_4$. Proteins were then added to the reaction as 2 mg/mg, protein/sugar. The reaction was carried out at 4° C. for 48 hours with rotation. Conjugates were separated by elution through a Sephacryl S500 gel filtration column and collection of the void volume fractions.

Stimulation of Mice Splenocytes and Human Peripheral Blood Mononuclear Cells (PBMC).

Spleens were harvested from either whole cell vaccine (WCV) immunized C57BL/6 mice or mice have been repeatedly colonized with S. pneumoniae were processed into a cellular suspension and stimulated with different concentration of recombinant proteins. Splenocytes were incubated for 3 days; plates were then spun to pellet cells, after which the supernatants were collected and assayed for IL-17A using a mouse IL-17A ELISA kit (R&D Systems, Inc).

Human PBMC were separated from healthy adult volunteers and cultured in 96 well plates. Cells were stimulated with different concentration of recombinant proteins for 4 days and then analyzed for IL-17A in the supernatant using a human IL-17A ELISA kit (ebioscience).

Antigen Preparations.

For intranasal (i.n.) immunization: Vaccines were prepared the same day of immunization by mixing purified proteins (5 µg) with 1 µg Cholera toxin (CT) per mouse in a final 20 µl of saline. For subcutaneous (s.c.) immunization: One day prior to immunization, vaccines were prepared as follows. Frozen aliquots were thawed or lyophilized vials were reconstituted with sterile water, diluted to the appropriate concentration, and mixed with aluminum hydroxide (alum) at the indicated concentration in a 15 ml conical tube, which was then tumbled overnight at 4° C. to allow for adsorption.

Immunization and Challenge of Mice.

C57BL/6J mice were used in all the experiments. The age at time of first immunization was between 4-6 weeks. I.n. immunization was done by instilling 20 µl of saline, adjuvant only, or adjuvant mixed with antigen as specified atraumatically into unanesthetized mice, a procedure that puts no immunogen into the lungs; secondary immunizations were given after one week. S.c. immunization was performed 3 times every two weeks. Gently restrained, nonanesthetized mice received injections of 200 µl containing adjuvant with or without antigen in the lower part of the back at 2-week intervals. Blood was drawn 2 weeks after the last immunization, and assayed for antibody and for IL-17A production in vitro upon stimulation with WCA. Nasopharyngeal colonization with the clinical pneumococcal isolate 0603 (serotype 6B) was carried out as previously described [4]. Intraperitoneal (IP) challenge was given 1000 cfu of strain WU2-ply (an engineered strain that replaced ply with His-tagged ply) in 200 µl PBS, and sickness or death of mice was monitored twice daily for 14 days. All animal studies were approved by our local animal ethics committees.

Enzyme-Linked Immunosorbent Assay (ELISA) and IL-17A Production in Whole Blood Samples.

Assays for murine antibodies for individual protein and IL-17A production in whole blood were carried out as previously described [2].

Binding of Antibody to Encapsulated Tigr4 Strains.

S. pneumoniae Tigr4 strain was grown to OD600=0.8 and collected by centrifugation. Bacteria were killed at 58° C. for 1 hour and washed with PBS twice. Bacteria were blocked with 1 ml PBS/1% BSA rotating overnight at 4° C. Cells were spun down and resuspended in 250 µl of PBS-Tween/1% BSA with 1:50 dilution of heat inactivated mouse serum. Samples were rotated at room temperature (RT) for 1 hour, and washed with PBS-Tween/1% BSA twice. 250 µl of PBS-Tween/1% BSA with 1:50 dilution of anti-mouse alexa Fluro 488 was added into cells and samples were rotated at RT for 1 hour. Samples were washed with PBS-Tween/1% BSA twice and then resuspended in 500 µl PBS. Flow cytometry was performed in Children's Hospital Boston.

Statistical Analysis.

Antibody and IL-17A concentrations and NP colonization densities were compared by the Mann-Whitney U test using PRISM (version 4.0a, GraphPad Software, Inc). Differences in survival were analyzed with the Kaplan-Meier test, using PRISM as well.

Example 1

Selection of Protein Candidates by Bioinformatic Analysis

At present, there are at least 42 S. pneumoniae sequences available from the integrated microbial genomes website (world wide web: "llimg.jgi.doe.gov/cgi-bin/w/main.cgi"). Beginning with the sequenced TIGR4 strain, the inventors analyzed the genome for predicted secretion signal peptides and cell wall anchor motifs. The inventors identified 335 proteins with a secretion signal peptide in TIGR4 and 15 proteins with possible cell wall anchor motifs.

The protein library was further narrowed down to 76 proteins based on the following parameters which were chosen a priori:

(a) Conservation across all the sequenced pneumococci (>90% identity at the amino acid level).

(b) Exclusion of any protein that had >40% homology with proteins in the human genome (c) Exclusion of proteins that contain an extracellular domain smaller than 100 amino acids.

The breakdown of the 76 proteins is as follows: 23 hypothetical proteins, 17 proteins that play a role in substrate binding and transportation, 17 proteins with enzymatic activities and 19 others of unknown or hypothetical function. A full list of the proteins and their sequence is shown in Table 2.

TABLE 2

A list of the pneumococcal proteins
SEQ ID NO: 1-83 and the primer sequences
for isolation and amplification.

| Proteins* | Predicted functions | Primer names | Sequences |
|---|---|---|---|
| SP0010 (23-end) (SEQ ID NO: 153) | hypothetical protein | Sp0010-1 | CGGGATCCGAATTCGA GCTCCGAAAAAGAAGT CGTCTATAC (SEQ ID NO: 233) |
|  |  | Sp0010-2 | CTCGAGTGCGGCCGCA AGCTTTTTTAGAACCT CATAAACATC (SEQ ID NO: 235) |
| SP0043 (42-end) (SEQ ID NO: 154) | competence factor transport protein ComB | Sp0043-1 | CGGGATCCGAATTCGA GCTCCGAGAAGGAGAT GAGTTTGTC (SEQ ID NO: 236) |
|  |  | Sp0043-2 | CTCGAGTGCGGCCGCA AGCTTCTCTTTGTTCA AAAATTGATC (SEQ ID NO: 237) |
| SP0079 (24-end) (SEQ ID NO: 155) | potassium uptake protein, Trk family | Sp0079-1 | CGGGATCCGAATTCGA GCTCCAAGCAGGATAT GAATATTATC (SEQ ID NO: 238) |
|  |  | Sp0079-2 | CTCGAGTGCGGCCGCA AGCTTCGAATTCAATG CTACTAGG (SEQ ID NO: 404) |
| SP0084 (110-end) (SEQ ID NO: 156) | histidine kinase (EC 2.7.13.3) (IMGterm) | Sp0084-1 | CGGGATCCGAATTCGA GCTCCTTTGATTCCTT GGAAGAAAG (SEQ ID NO: 405) |
|  |  | Sp0084-2 | CTCGAGTGCGGCCGCA AGCTTGGCTTTATTTT CACTACCAG (SEQ ID NO: 242) |
| SP0092 (30-end) (SEQ ID NO: 157) | carbohydrate ABC transporter substrate-binding protein, CUT1 family (TC 3.A.1.1.-) (IMGterm) | Sp0092-1 | CGGGATCCGAATTCGA GCTCCAACAGCAAAAA AGCTGCTG (SEQ ID NO: 243) |
|  |  | Sp0092-2 | CTCGAGTGCGGCCGCA AGCTTTTTTTGTTTT TCAAGAATTCATC (SEQ ID NO: 244) |
| SP0098 (30-end) (SEQ ID NO: 158) | hypothetical protein | Sp0098-1 | CGGGATCCGAATTCGA GCTCCGACGGGATTAA GAGCCTAC (SEQ ID NO: 245) |
|  |  | Sp0098-2 | CTCGAGTGCGGCCGCA AGCTTACGTCTGCTTG GTGTGGAT (SEQ ID NO: 246) |
| SP0106 (29-end) (SEQ ID NO: 159) | L-serine ammonia-lyase (EC 4.3.1.17) (IMGterm) | Sp0106-1 | CGGGATCCGAATTCGA GCTCCGTTCGTATTGG GAAGATTG (SEQ ID NO: 247) |
|  |  | Sp0106-2 | CTCGAGTGCGGCCGCA AGCTTTTTAAAGAAAT TGACATTGTG (SEQ ID NO: 248) |
| SP0107 (30-end) (SEQ ID NO: 160) | LysM domain protein | Sp0107-1 | CGGGATCCGAATTCGA GCTCCCAAGAATCATC AACTTACAC (SEQ ID NO: 249) |
|  |  | Sp0107-2 | CTCGAGTGCGGCCGCA AGCTTATACCAGCCAT TGTTAAGCC (SEQ ID NO: 250) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP0127 (26-end) (SEQ ID NO: 161) | hypothetical protein | Sp0127-1 | CGGGATCCGAATTCGA GCTCCGAGACGACGAT TAATATTAAG (SEQ ID NO: 251) |
| | | Sp0127-2 | CTCGAGTGCGGCCGCA AGCTTTAGGCGTTTAA TGTAAGACTC (SEQ ID NO: 252) |
| SP0149 (25-end) (SEQ ID NO: 162) | lipoprotein | Sp0149-1 | CGGGATCCGAATTCGA GCTCCAACTCAGAAAA GAAAGCAGAC (SEQ ID NO: 253) |
| | | Sp0149-2 | CTCGAGTGCGGCCGCA AGCTTCCAAACTGGTT GATCCAAAC (SEQ ID NO: 254) |
| SP0191 (26-end) (SEQ ID NO: 163) | hypothetical protein | Sp0191-1 | CGGGATCCGAATTCGA GCTCCCCAGCTACAAA AACAGAAAAAG (SEQ ID NO: 255) |
| | | Sp0191-2 | CTCGAGTGCGGCCGCA AGCTTTTGTTCTGTCG CGCCATTTGC (SEQ ID NO: 256) |
| SP0198 (45-end) (SEQ ID NO: 164) | hypothetical protein | Sp0198-1 | CGGGATCCGAATTCGA GCTCCAATACCAATAC TGCAAATGC (SEQ ID NO: 257) |
| | | Sp0198-2 | CTCGAGTGCGGCCGCA AGCTTTTTAGTTAAAA CGATTTGGTC (SEQ ID NO: 258) |
| SP0249 (26-end) (SEQ ID NO: 165) | PTS system, IIB component | Sp0249-1 | CGGGATCCGAATTCGA GCTCCCAATCTAGTGG AGTTGAGG (SEQ ID NO: 259) |
| | | Sp0249-2 | CTCGAGTGCGGCCGCA AGCTTCCCACTAATCA AAGATAGG (SEQ ID NO: 260) |
| SP0321 (1-end) (SEQ ID NO: 14) | PTS system, IIA component | Sp0321-1 | CGGGATCCGAATTCGA GCTCCATGAAAATTGT ACTTGTAG (SEQ ID NO: 261) |
| | | Sp0321-2 | CTCGAGTGCGGCCGCA AGCTTAATACCCGATT CGAAATCTTC (SEQ ID NO: 263) |
| SP0346 (98-end) (SEQ ID NO: 166) | capsular polysaccharide biosynthesis protein Cps4A | Sp0346-1 | CGGGATCCGAATTCGA GCTCCGGACTGACCAA TCGTTTAAATG (SEQ ID NO: 264) |
| | | Sp0346-2 | CTCGAGTGCGGCCGCA AGCTTTCTACCCTCCA TCACATCC (SEQ ID NO: 265) |
| SP0402 (29-end) (SEQ ID NO: 167) | signal peptidase. Serine peptidase. MEROPS family S26A (IMGterm) | Sp0402-1 | CGGGATCCGAATTCGA GCTCCTGGAGCAATGT TCGCGTAG (SEQ ID NO: 266) |
| | | Sp0402-2 | CTCGAGTGCGGCCGCA AGCTTAAATGTTCCGA TACGGGTG (SEQ ID NO: 267) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP0453 (25-298) (SEQ ID NO: 168) | amino acid ABC transporter substrate-binding protein, PAAT family (TC 3.A.1.3.-)/amino acid ABC transporter membrane protein, PAAT family (TC 3.A.1.3.-) (IMGterm) | Sp0453-1 | CGGGATCCGAATTCGA GCTCCGATGAATATTT ACGCATCG (SEQ ID NO: 268) |
| | | Sp0453-2 | CTCGAGTGCGGCCGCA AGCTTACCAGCACCAC GCAAGAG (SEQ ID NO: 269) |
| SP0564 (21-end) (SEQ ID NO: 169) | hypothetical protein | Sp0564-1 | CGGGATCCGAATTCGA GCTCCTTTTCAAGTAC GGTGACTAAG (SEQ ID NO: 270) |
| | | Sp0564-2 | CTCGAGTGCGGCCGCA AGCTTCTTGAACTTGA TGCCATTTTC (SEQ ID NO: 271) |
| SP0582 (92-end) (SEQ ID NO: 170) | hypothetical protein | Sp0582-1 | CGGGATCCGAATTCGA GCTCCGATAAAACCCT TTCTTCTGC (SEQ ID NO: 272) |
| | | Sp0582-2 | CTCGAGTGCGGCCGCA AGCTTAAATGTGATTT CTGTAAAAATAC (SEQ ID NO: 273) |
| SP0589 (36-end) (SEQ ID NO: 171) | serine O-acetyltransferase (EC 2.3.1.30) (IMGterm) | Sp0589-1 | CGGGATCCGAATTCGA GCTCCGCCCACCGTCT CTCGCAT (SEQ ID NO: 274) |
| | | Sp0589-2 | CTCGAGTGCGGCCGCA AGCTTCAAACCAGACG ATCTGTGAC (SEQ ID NO: 275) |
| SP0601 (36-297) (SEQ ID NO: 172) | transmembrane protein Vexp3 | Sp0601-1 | CGGGATCCGAATTCGA GCTCCATCAAGGGAGC TACTGCCAAG (SEQ ID NO: 276) |
| | | Sp0601-2 | CTCGAGTGCGGCCGCA AGCTTCATACCAGAGA TAGATTGCTC (SEQ ID NO: 277) |
| SP0604 (223-end) (SEQ ID NO: 173) | sensor histidine kinase VncS | Sp0604-1 | CGGGATCCGAATTCGA GCTCCGAAGCCATTCT CCAGCTGG (SEQ ID NO: 278) |
| | | Sp0604-2 | CTCGAGTGCGGCCGCA AGCTTGTCTTGGACGA CTTTTGG (SEQ ID NO: 279) |
| SP0617 (44-end) (SEQ ID NO: 174) | hypothetical protein | Sp0617-1 | CGGGATCCGAATTCGA GCTCCAACGGAGATTT TCAAGGAGC (SEQ ID NO: 280) |
| | | Sp0617-2 | CTCGAGTGCGGCCGCA AGCTTCTCACTAGTCT CATATATTTTC (SEQ ID NO: 281) |
| SP0620 (27-end) (SEQ ID NO: 175) | amino acid ABC transporter substrate-binding protein, PAAT family (TC 3.A.1.3.-) (IMGterm) | Sp0620-1 | CGGGATCCGAATTCGA GCTCCAGCGCTCAAAA GACAATCG (SEQ ID NO: 282) |
| | | Sp0620-2 | CTCGAGTGCGGCCGCA AGCTTTTGTAACTGAG ATTGATCTG (SEQ ID NO: 283) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP0629 (21-end) (SEQ ID NO: 176) | D-Ala-D-Ala carboxypeptidase. Metallo peptidase. MEROPS family M15B (IMGterm) | Sp0629-1 | CGGGATCCGAATTCGA GCTCCCAAGAAAAAAC AAAAAATGAAG (SEQ ID NO: 284) |
|  |  | Sp0629-2 | CTCGAGTGCGGCCGCA AGCTTATCGACGTAGT CTCCGCC (SEQ ID NO: 285) |
| SP0648 (40-776) (SEQ ID NO: 177) | beta-galactosidase (EC:3.2.1.23) (IMGterm) | Sp0648-1 | CGGGATCCGAATTCGA GCTCCGAATCTGTAGT TTATGCGG (SEQ ID NO: 286) |
|  |  | Sp0648-2 | CTCGAGTGCGGCCGCA AGCTTTGCTAATTCTT TGTTTTCC (SEQ ID NO: 287) |
| SP0648 (777-1676) (SEQ ID NO: 178) |  | Sp0648-3 | CGGGATCCGAATTCGA GCTCCTCCAAAGTAGC TGACTCAG (SEQ ID NO: 288) |
|  |  | Sp0648-4 | CTCGAGTGCGGCCGCA AGCTTAGACTCAAGGT AGTAGTCTG (SEQ ID NO: 289) |
| SP0648 (1677-end) (SEQ ID NO: 179) |  | Sp0648-5 | CGGGATCCGAATTCGA GCTCCGTAGATGGAAA AGTTCCG (SEQ ID NO: 290) |
|  |  | Sp0648-6 | CTCGAGTGCGGCCGCA AGCTTGTCTTCTTTTT TACCTTTAG (SEQ ID NO: 291) |
| SP0659 (28-end) (SEQ ID NO: 180) | thioredoxin family protein | Sp0659-1 | CGGGATCCGAATTCGA GCTCCGAACACCAAAC GAAAGATG (SEQ ID NO: 292) |
|  |  | Sp0659-2 | CTCGAGTGCGGCCGCA AGCTTGGCTAATTCCT TCAAAGTTTG (SEQ ID NO: 293) |
| SP0662 (29-276) (SEQ ID NO: 181) | sensor histidine kinase, putative | Sp0662-1 | CGGGATCCGAATTCGA GCTCCTACTATCAATC AAGTTCTTC (SEQ ID NO: 294) |
|  |  | Sp0662-2 | CTCGAGTGCGGCCGCA AGCTTGAGCTGACTCC GAACCTGGTC (SEQ ID NO: 295) |
| SP0662 (300-end) (SEQ ID NO: 182) |  | Sp0662-3 | CGGGATCCGAATTCGA GCTCCAAACGCTGGAT TGCTCCT (SEQ ID NO: 296) |
|  |  | Sp0662-4 | CTCGAGTGCGGCCGCA AGCTTGCTAGTTTCTA TTCTATTTAT (SEQ ID NO: 297) |
| SP0664 (103-629) (SEQ ID NO: 183) | zinc metalloprotease ZmpB | Sp0664-1 | CGGGATCCGAATTCGA GCTCCACCCTAGCGCT GGCTAGTCG (SEQ ID NO: 298) |
|  |  | Sp0664-2 | CTCGAGTGCGGCCGCA AGCTTCTCAACTTTTT TAAGATCTA (SEQ ID NO: 299) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP0664 (630-1200) (SEQ ID NO: 184) | | Sp0664-3 | CGGGATCCGAATTCGA GCTCCCTTAAAAATAT TAAACGTAC (SEQ ID NO: 300) |
| | | Sp0664-4 | CTCGAGTGCGGCCGCA AGCTTGATTGCATTAA CTCTATAGTC (SEQ ID NO: 301) |
| SP0664 (1201-end) (SEQ ID NO: 185) | | Sp0664-5 | CGGGATCCGAATTCGA GCTCCAAAGATTTATA TTTAGAAG (SEQ ID NO: 302) |
| | | Sp0664-6 | CTCGAGTGCGGCCGCA AGCTTTTTAAAGATTG AAGTTTTAAAGC (SEQ ID NO: 303) |
| SP0678 (23-end) (SEQ ID NO: 186) | hypothetical protein | Sp0678-1 | CGGGATCCGAATTCGA GCTCCCGTATTCGCCG TGCGGCTA (SEQ ID NO: 304) |
| | | Sp0678-2 | CTCGAGTGCGGCCGCA AGCTTGCTAGTCTTCA CTTTCC (SEQ ID NO: 305) |
| SP0724 (35-end) (SEQ ID NO: 187) | hydroxyethylthiazole kinase, putative | Sp0724-1 | CGGGATCCGAATTCGA GCTCCGATGATTCCCG TGAAGTTC (SEQ ID NO: 306) |
| | | Sp0724-2 | CTCGAGTGCGGCCGCA AGCTTTTCATAAACCT CTCCTTTG (SEQ ID NO: 307) |
| SP0742 (43-end) (SEQ ID NO: 188) | hypothetical protein | Sp0742-1 | CGGGATCCGAATTCGA GCTCCGCTGATCAGGT CTTTGTTG (SEQ ID NO: 308) |
| | | Sp0742-2 | CTCGAGTGCGGCCGCA AGCTTATCAATTTCAT AGCCCATCAG (SEQ ID NO: 309) |
| SP0757 (44-451) (SEQ ID NO: 189) | cell division protein FtsX (IMGterm) | Sp0757-1 | CGGGATCCGAATTCGA GCTCCATTTTCAATAC AGCGAAAC (SEQ ID NO: 310) |
| | | Sp0757-2 | CTCGAGTGCGGCCGCA AGCTTAAATGAAGCTA ACTTGAAGAG (SEQ ID NO: 311) |
| SP0785 (33-end) (SEQ ID NO: 190) | hypothetical protein | Sp0785-1 | CGGGATCCGAATTCGA GCTCCTTTAGACAACC TTCTCAGAC (SEQ ID NO: 312) |
| | | Sp0785-2 | CTCGAGTGCGGCCGCA AGCTTATTAGTTGCTT CATCAGCC (SEQ ID NO: 313) |
| SP0787 (43-290) (SEQ ID NO: 191) | hypothetical protein | Sp0787-1 | CGGGATCCGAATTCGA GCTCCTCTCGTCAAGT CAATAAAG (SEQ ID NO: 314) |
| | | Sp0787-2 | CTCGAGTGCGGCCGCA AGCTTCGTCGTCATAA AACTAAACG (SEQ ID NO: 315) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP0872 (30-end) (SEQ ID NO: 192) | D,D-carboxypeptidase PBP3. Serine peptidase. MEROPS family S11 (IMGterm) | Sp0872-1 | CGGGATCCGAATTCGA GCTCCAAACATGCGAT TGCTGTTG (SEQ ID NO: 316) |
| | | Sp0872-2 | CTCGAGTGCGGCCGCA AGCTTTAATTTCTCGT TAACAAAGCG (SEQ ID NO: 317) |
| SP0878 (245-end) (SEQ ID NO: 193) | SpoE family protein | Sp0878-1 | CGGGATCCGAATTCGA GCTCCACAGAGGAAGC TGTTCAAAATC (SEQ ID NO: 318) |
| | | Sp0878-2 | CTCGAGTGCGGCCGCA AGCTTTTGTTGTAACA CTTTTCGAGG (SEQ ID NO: 319) |
| SP0899 (31-end) (SEQ ID NO: 194) | hypothetical protein | Sp0899-1 | CGGGATCCGAATTCGA GCTCCGAGGGGACGAA TCAAAGGC (SEQ ID NO: 320) |
| | | Sp0899-2 | CTCGAGTGCGGCCGCA AGCTTAAGTTTAACCC ACTTATCATTATC (SEQ ID NO: 321) |
| SP1002 (22-end) (SEQ ID NO: 195) | adhesion lipoprotein | Sp1002-1 | CGGGATCCGAATTCGA GCTCCGGTCAAAAGGA AAGTCAGAC (SEQ ID NO: 322) |
| | | Sp1002-2 | CTCGAGTGCGGCCGCA AGCTTCTTTAATTCTT CTGCTAGAATAC (SEQ ID NO: 323) |
| SP1026 (24-end) (SEQ ID NO: 196) | hypothetical protein | Sp1026-1 | CGGGATCCGAATTCGA GCTCCGTTCATCAAGA TGTCAAAC (SEQ ID NO: 324) |
| | | Sp1026-2 | CTCGAGTGCGGCCGCA AGCTTGCCAGATGTTG AAAAGAGAG (SEQ ID NO: 325) |
| SP1032 (22-end) (SEQ ID NO: 197) | iron-compound ABC transporter, iron compound-binding protein | Sp1032-1 | CGGGATCCGAATTCGA GCTCCTCTAATTCTGT TAAAAATGAAG (SEQ ID NO: 326) |
| | | Sp1032-2 | CTCGAGTGCGGCCGCA AGCTTTTTCGCATTTT TGCATGCATTTC (SEQ ID NO: 327) |
| SP1069 (34-end) (SEQ ID NO: 198) | hypothetical protein | Sp1069-1 | CGGGATCCGAATTCGA GCTCCTCTTCAATGAA TAAATCAG (SEQ ID NO: 328) |
| | | Sp1069-2 | CTCGAGTGCGGCCGCA AGCTTTTCGATGACTT GTCCTGCTTC (SEQ ID NO: 329) |
| SP1154 (155-694) (SEQ ID NO: 199) | IgA1-specific metallopeptidase. Metallo peptidase. MEROPS family M26 (IMGterm) | Sp1154-1 | CGGGATCCGAATTCGA GCTCCGAAAATCATCT TTTGCTAAATTAC (SEQ ID NO: 330) |
| | | Sp1154-2 | CTCGAGTGCGGCCGCA AGCTTTGTGTTTGATT CGGTTGAAAC (SEQ ID NO: 331) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP1154 (695-1374) (SEQ ID NO: 200) | | Sp1154-3 | CGGGATCCGAATTCGA GCTCCTCCAATTCAAA TGGAAACG (SEQ ID NO: 332) |
| | | Sp1154-4 | CTCGAGTGCGGCCGCA AGCTTACCAAAGAAGT CCAAATGG (SEQ ID NO: 333) |
| SP1154 (1375-end) (SEQ ID NO: 201) | | Sp1154-5 | CGGGATCCGAATTCGA GCTCCAAGGGGAATGC TTCACCATTAG (SEQ ID NO: 334) |
| | | Sp1154-6 | CTCGAGTGCGGCCGCA AGCTTTTTTTATTCT CAAAAATTG (SEQ ID NO: 335) |
| SP1267 (25-end) (SEQ ID NO: 202) | licC protein | Sp1267-1 | CGGGATCCGAATTCGA GCTCCTTGGTTCAGGT TAATCAAAAAC (SEQ ID NO: 336) |
| | | Sp1267-2 | CTCGAGTGCGGCCGCA AGCTTATTTTCGTTTT TAAGAATTTC (SEQ ID NO: 337) |
| SP1376 (32-end) (SEQ ID NO: 203) | shikimate dehydrogenase (EC 1.1.1.25) (IMGterm) | Sp1376-1 | CGGGATCCGAATTCGA GCTCCGCGACAGCTAC CAACGGTG (SEQ ID NO: 338) |
| | | Sp1376-2 | CTCGAGTGCGGCCGCA AGCTTTTGGTATTTTT CTGTTAAAG (SEQ ID NO: 339) |
| SP1386 (33-end) (SEQ ID NO: 204) | spermidine/ putrescine ABC transporter, spermidine/ putrescine-binding protein | Sp1386-1 | CGGGATCCGAATTCGA GCTCCGATAGTCAAAA ATTGGTTATC (SEQ ID NO: 340) |
| | | Sp1386-2 | CTCGAGTGCGGCCGCA AGCTTCTTCCGATACA TTTTAAACTG (SEQ ID NO: 341) |
| SP1404 (31-end) (SEQ ID NO: 205) | hypothetical protein | Sp1404-1 | CGGGATCCGAATTCGA GCTCCGCCTATGAAGG CAAAGTAG (SEQ ID NO: 342) |
| | | Sp1404-2 | CTCGAGTGCGGCCGCA AGCTTCTTTCCAAGAG AAATCTTTC (SEQ ID NO: 343) |
| SP1405 (19-end) (SEQ ID NO: 206) | transcriptional regulator Spx | Sp1405-1 | CGGGATCCGAATTCGA GCTCCTGGTTAGAAAA ACATAAGG (SEQ ID NO: 344) |
| | | Sp1405-2 | CTCGAGTGCGGCCGCA AGCTTCTAATACCAGC TCTCATTC (SEQ ID NO: 345) |
| SP1419 (27-end) (SEQ ID NO: 207) | acetyltransferase, GNAT family | Sp1419-1 | CGGGATCCGAATTCGA GCTCCATGTTTCAAAA TTGGGCTTC (SEQ ID NO: 346) |
| | | Sp1419-2 | CTCGAGTGCGGCCGCA AGCTTACATTCTTCCC TACTTATACC (SEQ ID NO: 347) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP1479 (40-end) (SEQ ID NO: 208) | peptidoglycan N-acetylglucosamine deacetylase A | Sp1479-1 | CGGGATCCGAATTCGA GCTCCAAGATCTACCA GCAAAAAAG (SEQ ID NO: 348) |
| | | Sp1479-2 | CTCGAGTGCGGCCGCA AGCTTTTCATCACGAC TATAGTACAGC (SEQ ID NO: 349) |
| SP1500 (27-end) (SEQ ID NO: 209) | amino acid ABC transporter substrate-binding protein, PAAT family (TC 3.A.1.3.-) (IMGterm) | Sp1500-1 | CGGGATCCGAATTCGA GCTCCACTAGTGGAGA TAATTGGTC (SEQ ID NO: 350) |
| | | Sp1500-2 | CTCGAGTGCGGCCGCA AGCTTCTGTCCTTCTT TTACTTCTTTG (SEQ ID NO: 351) |
| SP1545 (29-end) (SEQ ID NO: 210) | hypothetical protein | Sp1545-1 | CGGGATCCGAATTCGA GCTCCGAAGGAGAAAA ATTAGCTC (SEQ ID NO: 352) |
| | | Sp1545-2 | CTCGAGTGCGGCCGCA AGCTTTAGGCCCTCCT TGTTGACC (SEQ ID NO: 353) |
| SP1560 (28-end) (SEQ ID NO: 211) | hypothetical protein | Sp1560-1 | CGGGATCCGAATTCGA GCTCCCAAAACAGTAC CAGTGCTAG (SEQ ID NO: 354) |
| | | Sp1560-2 | CTCGAGTGCGGCCGCA AGCTTATTCGTTTTTG AACTAGTTGC (SEQ ID NO: 355) |
| SP1624 (1-217) (SEQ ID NO: 212) | 1-acyl-sn-glycerol-3-phosphate acyltransferase (EC 2.3.1.51) (IMGterm) | Sp1624-1 | CGGGATCCGAATTCGA GCTCCATGTTTTATAC TTATTTGCGTG (SEQ ID NO: 356) |
| | | Sp1624-2 | CTCGAGTGCGGCCGCA AGCTTGGCAGGGATGC GGATAAACC (SEQ ID NO: 357) |
| SP1652 (62-397) (SEQ ID NO: 213) | hypothetical protein | Sp1652-1 | CGGGATCCGAATTCGA GCTCCAAAGTAACCAG TCCCAACATGG (SEQ ID NO: 358) |
| | | Sp1652-2 | CTCGAGTGCGGCCGCA AGCTTACTGGATGAAG CATTGCTATAC (SEQ ID NO: 359) |
| SP1683 (65-end) (SEQ ID NO: 214) | carbohydrate ABC transporter substrate-binding protein, CUT1 family (TC 3.A.1.1.-) (IMGterm) | Sp1683-1 | CGGGATCCGAATTCGA GCTCCAAATCAATCAT CGAAGCGTTTG (SEQ ID NO: 360) |
| | | Sp1683-2 | CTCGAGTGCGGCCGCA AGCTTTTGTTTCATAG CTTTTTTGATTG (SEQ ID NO: 361) |
| SP1826 (36-end) (SEQ ID NO: 215) | ABC transporter, substrate-binding protein | Sp1826-1 | CGGGATCCGAATTCGA GCTCCATGCCTAATTA TAAATTTGTTG (SEQ ID NO: 362) |
| | | Sp1826-2 | CTCGAGTGCGGCCGCA AGCTTTTTTCTACCCT CCTTTTCC (SEQ ID NO: 363) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP1872 (40-end) (SEQ ID NO: 216) | iron-compound ABC transporter, iron-compound-binding protein | Sp1872-1 | CGGGATCCGAATTCGA GCTCCGAAGAAAAAGC TGATAAAAGTC (SEQ ID NO: 364) |
| | | Sp1872-2 | CTCGAGTGCGGCCGCA AGCTTGCTGAATTAGA ATACGTACAA (SEQ ID NO: 365) |
| SP1891 (40-end) (SEQ ID NO: 217) | oligopeptide ABC transporter, oligopeptide-binding protein AmiA | Sp1891-1 | CGGGATCCGAATTCGA GCTCCACAGAGGTAAC CATTAAAAG (SEQ ID NO: 366) |
| | | Sp1891-2 | CTCGAGTGCGGCCGCA AGCTTTTTCAAAGCTT TTTGTATGTC (SEQ ID NO: 367) |
| SP1897 (30-end) (SEQ ID NO: 218) | multiple sugar-binding protein (IMGterm) | Sp1897-1 | CGGGATCCGAATTCGA GCTCCGCGGATGGCAC AGTGACC (SEQ ID NO: 368) |
| | | Sp1897-2 | CTCGAGTGCGGCCGCA AGCTTATCCACATCCG CTTTCATC (SEQ ID NO: 369) |
| SP1942 (37-end) (SEQ ID NO: 219) | transcriptional regulator, putative | Sp1942-1 | CGGGATCCGAATTCGA GCTCCAAAACCTATAA AAAAATCGGTG (SEQ ID NO: 370) |
| | | Sp1942-2 | CTCGAGTGCGGCCGCA AGCTTATTATCTTCAT CACCAACAGG (SEQ ID NO: 371) |
| SP1966 (25-end) (SEQ ID NO: 220) | UDP-N-acetylglucosamine 1-carboxyvinyltransferase (EC 2.5.1.7) (IMGterm) | Sp1966-1 | CGGGATCCGAATTCGA GCTCCGCAGTCTTACC CTTGTTGGC (SEQ ID NO: 372) |
| | | Sp1966-2 | CTCGAGTGCGGCCGCA AGCTTTTCATCTTCAT CACTTGCC (SEQ ID NO: 373) |
| SP1967 (30-end); (SEQ ID NO: 221) | hypothetical protein | Sp1967-1 | CGGGATCCGAATTCGA GCTCCATAGAGGTTCC AGGTGGTTCG (SEQ ID NO: 374) |
| | | Sp1967-2 | CTCGAGTGCGGCCGCA AGCTTGGGATTGTTTT TCAAGTAATC (SEQ ID NO: 375) |
| SP1998 (51-end) (SEQ ID NO: 222) | asparaginase (EC 3.5.1.1) (IMGterm) | Sp1998-1 | CGGGATCCGAATTCGA GCTCCGGGATTGTTTT TCAAGTAATC (SEQ ID NO: 376) |
| | | Sp1998-2 | CTCGAGTGCGGCCGCA AGCTTGCCTTCCATAT AGTCTTTC (SEQ ID NO: 377) |
| SP2048 (40-end) (SEQ ID NO: 223) | hypothetical protein | Sp2048-1 | CGGGATCCGAATTCGA GCTCCAGTCAGCTCCT CATTTCAG (SEQ ID NO: 378) |
| | | Sp2048-2 | CTCGAGTGCGGCCGCA AGCTTACTTTTTTCTT TTTCCACAC (SEQ ID NO: 379) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP2050 (35-end) (SEQ ID NO: 224) | competence protein CglD | Sp2050-1 | CGGGATCCGAATTCGA GCTCCGTAGAGGAACA GATTTTCT (SEQ ID NO: 380) |
| | | Sp2050-2 | CTCGAGTGCGGCCGCA AGCTTATTTTTTGTTT CCTTAATGCG (SEQ ID NO: 381) |
| SP2083 (192-end) (SEQ ID NO: 225) | sensor histidine kinase PnpS | Sp2083-1 | CGGGATCCGAATTCGA GCTCCTTTAGCCCCAC CCAATCTGTG (SEQ ID NO: 382) |
| | | Sp2083-2 | CTCGAGTGCGGCCGCA AGCTTGTCCTGTGCGA AAGATTGG (SEQ ID NO: 383) |
| SP2084 (30-end) (SEQ ID NO: 226) | phosphate ABC transporter substrate-binding protein, PhoT family (TC 3.A.1.7.1) (IMGterm) | Sp2084-1 | CGGGATCCGAATTCGA GCTCCAAACAGTCAGC TTCAGGAAC (SEQ ID NO: 384) |
| | | Sp2084-2 | CTCGAGTGCGGCCGCA AGCTTTTTAATCTTGT CCCAGGTGG (SEQ ID NO: 385) |
| SP2088 (30-end); (SEQ ID NO: 227) | phosphate uptake regulator, PhoU (IMGterm) | Sp2088-1 | CGGGATCCGAATTCGA GCTCCGCCTTACTGGC CTTAGCCTCC (SEQ ID NO: 386) |
| | | Sp2088-2 | CTCGAGTGCGGCCGCA AGCTTATTCAAATCCA CTAGTTCTC (SEQ ID NO: 387) |
| SP2145 (1-end) (SEQ ID NO: 70) | antigen, cell wall surface anchor family | Sp2145-1 | CGGGATCCGAATTCGA GCTCCATGAAACCACT ACTTGAAACC (SEQ ID NO: 388) |
| | | Sp2145-2 | CTCGAGTGCGGCCGCA AGCTTGTGACTTGGTA ACCAGCTG (SEQ ID NO: 389) |
| SP2151 (25-end) (SEQ ID NO: 228) | carbamate kinase (EC 2.7.2.2) (IMGterm) | Sp2151-1 | CGGGATCCGAATTCGA GCTCCCAACAAGAAGC TTTAGTTG (SEQ ID NO: 390) |
| | | Sp2151-2 | CTCGAGTGCGGCCGCA AGCTTTCCTTTTTCAA TAATTGTTCC (SEQ ID NO: 391) |
| SP2187 (32-end); (SEQ ID NO: 229) | hypothetical protein | Sp2187-1 | CGGGATCCGAATTCGA GCTCCGTAATGGAAGA AACAGGAT (SEQ ID NO: 392) |
| | | Sp2187-2 | CTCGAGTGCGGCCGCA AGCTTAGTGAATAATA ACTGGCGAATC (SEQ ID NO: 393) |
| SP2192 (224-end) (SEQ ID NO: 230) | sensor histidine kinase | Sp2192-1 | CGGGATCCGAATTCGA GCTCCGAGCAAATTGT AAAATTGC (SEQ ID NO: 394) |
| | | Sp2192-2 | CTCGAGTGCGGCCGCA AGCTTCAAGCTAATCT TAAATTCC (SEQ ID NO: 395) |

TABLE 2-continued

A list of the pneumococcal proteins
SEQ ID NO: 1-83 and the primer sequences
for isolation and amplification.

| Proteins* | Predicted functions | Primer names | Sequences |
|---|---|---|---|
| SP2197 (30-end) (SEQ ID NO: 231) | ABC transporter, substrate-binding protein, putative | Sp2197-1 | CGGGATCCGAATTCGA GCTCCAAAGACAACAA AGAGGCAGAAC (SEQ ID NO: 396) |
| | | Sp2197-2 | CTCGAGTGCGGCCGCA AGCTTTTTCACAAATT CGTTGGTGAAG (SEQ ID NO: 397) |
| SP2207 (30-end) (SEQ ID NO: 232) | competence protein ComF, putative | Sp2207-1 | CGGGATCCGAATTCGA GCTCCTGTTCAGACTG TGATTCTAC (SEQ ID NO: 398) |
| | | Sp2207-2 | CTCGAGTGCGGCCGCA AGCTTTCTTACAAGGG AAAATGTT (SEQ ID NO: 399) |
| SP2218 (106-end) (SEQ ID NO: 234) | rod shape-determining protein MreC (IMGterm) | Sp2218-1 | CGGGATCCGAATTCGA GCTCCTCTAAATTGCA AGCCACAAAG (SEQ ID NO: 400) |
| | | Sp2218-2 | CTCGAGTGCGGCCGCA AGCTTTGAATTCCCCA CTAATTCTATC (SEQ ID NO: 401) |

*Amino acid residues used for cloning; end refers to C-terminus.

Example 2

Screening Antigens from Mouse Splenocytes and Human Peripheral Blood Mononuclear Cells (PBMC)

60 proteins out of 80 genetic constructs were successfully cloned and expressed in, then purified from, *E. coli*. These proteins were then used in stimulation experiments with either mouse splenocytes or human PBMC to evaluate the ability of these proteins to recall a potent IL-17A response (elicitation of IL-17A responses is a predictor of immunogenicity and protection against colonization by a pneumococcal antigen—(see Moffitt K L, Gierahn T M, Lu Y J, et al. T(H)17-Based Vaccine Design for Prevention of *Streptococcus pneumoniae* Colonization. Cell Host Microbe 2011; 9:158-65).

The mouse splenocytes were obtained from three sources: 1. Mice previously immunized with a whole cell vaccine (WCV); 2. Mice previously colonized with a single strain of *S. pneumoniae* for 10 days and 3. Mice were sequentially colonized with *S. pneumoniae* serotype 6B, 14F and 19F strains. These three different models were used to identify putative protective surface antigens, as the inventors assessed if these antigens are sufficiently expressed during colonization to elicit a response by immune cells following colonization. Furthermore, the inventors assessed if some of the surface proteins would also confer protection against colonization and/or invasive disease in mice. Any given protein may provide protection against colonization, invasive disease, or both; since both colonization and invasive disease prevention are important goals of vaccination, the evaluation of the ability to confer protection in either model was included. The inventors also assessed if humans—who are all naturally exposed to pneumococci during their lifetime—were also capable of responding to the proteins, as more evidence that this protein may be expressed during human colonization. The responses to each protein in the different screens are summarized in Table 3 (which also includes whether the protein is protective against colonization, to be discussed below).

TABLE 3

Summary of IL-17A response to protein stimulation and protection against colonization.

| Proteins | Mouse IL-17A (responses to 0.2/1/5 µg of protein)* | Human IL-17A (responses to 1/10 µg of protein)* | Protection in mice |
|---|---|---|---|
| SP0346 | +/++/++ | −/− | No |
| SP0648 | +/++/+ | −/− | No |
| SP0785 | +/−/++ | +/+ | Yes |
| SP0787 | +++/−/− | +/− | No |
| SP1154 | ++/+++/− | −/− | No |
| SP1376 | −/−/++ | −/+ | No |
| SP1500 | +/−/− | +++/− | Yes |
| SP1545 | −/−/− | ++/− | No |
| SP1872 | −/−/− | +++/− | No |
| SP1897 | +/−/− | ++/+ | No |
| SP1942 | +/−/++ | +/− | No |
| SP2145 | −/−/+ | +/− | No |
| SP2151 | ++/++/+++ | −/− | No |
| SP2207 | +/++/+ | +/− | No |
| SP0043 | +/−/− | −/− | ND** |
| SP0079 | +/+++/− | −/− | ND** |
| SP0084 | +/++/− | −/+ | ND** |
| SP0092 | +/+/− | −/+ | ND** |
| SP0098 | +/+++/++ | −/− | ND** |
| SP0149 | −/−/− | +/+ | ND** |
| SP0191 | +/−/− | −/+ | ND** |
| SP0198 | −/+/− | +/− | ND** |
| SP0249 | −/++/+++ | −/+ | ND** |
| SP0321 | −/+/− | −/− | ND** |
| SP0402 | −/−/− | −/− | ND** |

TABLE 3-continued

Summary of IL-17A response to protein stimulation and protection against colonization.

| Proteins | Mouse IL-17A (responses to 0.2/1/5 μg of protein)* | Human IL-17A (responses to 1/10 μg of protein)* | Protection in mice |
|---|---|---|---|
| SP0453 | ++/+++/− | ND** | ND** |
| SP0564 | +/−/− | ++/− | ND** |
| SP0582 | +/+++/− | −/− | ND** |
| SP0601 | −/−/− | +/− | ND** |
| SP0604 | −/−/+ | +/− | ND** |
| SP0617 | −/−/− | +/+ | ND** |
| SP0620 | −/++/− | +/− | ND** |
| SP0629 | −/−/− | +/+ | ND** |
| SP0659 | −/−/− | +/− | ND** |
| SP0662 | +/−/− | +/− | ND** |
| SP0678 | −/+/− | −/− | ND** |
| SP0757 | +/−/++ | −/− | ND** |
| SP0878 | −/−/− | −/− | ND** |
| SP0899 | ++/−/− | +/− | ND** |
| SP1002 | +/+/− | −/− | ND** |
| SP1032 | +/−/+ | ++/− | ND** |
| SP1069 | +/+/− | +/− | ND** |
| SP1386 | −/−/+ | +/− | ND** |
| SP1404 | +/−/− | −/− | ND** |
| SP1479 | −/−/− | −/− | ND** |
| SP1560 | −/−/− | +++/− | ND** |
| SP1652 | −/−/− | ++/− | ND** |
| SP1683 | +/+/+ | −/− | ND** |
| Sp1826 | −/−/− | ND** | ND** |
| SP2084 | +/+/+ | +/− | ND** |
| SP2192 | −/−/− | +/− | ND** |
| SP2197 | +/−/− | +++/− | ND** |
| SP2218 | +/−/− | −/+ | ND** |

*IL-17A production in response to protein stimulation: −, <25 pg/ml, +, >25 pg/ml, ++, >100 pg/ml, +++, >250 pg/ml,
**ND, not determined Example 3

SP0785 and SP1500 Provide Protection Against Colonization

The inventors then tested the 14 antigens to see if they could provide protection in a mouse colonization model. For each protein tested, 5 mg of each antigen were mixed with adjuvant CT and used to immunize mice twice weekly. Mice were challenged with a serotype 6B pneumococcal strain and the protection was accessed 7 days later for pneumococcal colonization in the nose. Two proteins, SP0785 and SP1500 showed significant protection compared to the adjuvant alone group (p=0.0023 and p=0.0009 for SP0785 and SP1500, respectively) (FIG. 1). The other 12 antigens tested were not protective in this colonization model.

Example 4

Protection Against Sepsis Challenge

At the same time, the inventors evaluated whether these proteins could confer protection, when used as immunogens, against invasive disease. Groups (n=10 mice per group) of C57/BL6 mice were immunized with one of the 15 proteins subcutaneously with aluminum hydroxide as adjuvant and then challenged in an intraperitoneal (IP) infection model with an engineered WU2 strain (wild type ply replaced with a tagged ply). This infection leads to 80% death of control mice starting at 3-4 days post infection. As summarized in Table 4, protein SP0346 protected 60% of the immunized mice compared to 20% of the alum group (p=0.0254). Four proteins protected 50% of mice, such as SP1386, SP1500, SP0084 and SP1479. The protection from the remaining 10 proteins was lower than 50%.

TABLE 4

Protection against sepsis following immunization by the subcutaneous route, using aluminum hydroxide as adjuvant.

| Proteins | Survival rate (survival/total) |
|---|---|
| None | 2/10 |
| SP0785 | 3/10 |
| SP2145 | 1/10 |
| SP1826 | 3/10 |
| SP0191 | 3/10 |
| SP0198 | 4/10 |
| SP0564 | 4/10 |
| Sp1069 | 2/10 |
| SP1942 | 3/10 |
| SP2151 | 3/10 |
| SP2197 | 0/10 |
| SP1386 | 5/10 |
| SP1500 | 5/10 |
| SP0084 | 5/10 |
| SP1479 | 5/10 |
| SP0346 | 6/10 |

Example 5

Protection Against Sepsis by Proteins Fusing to PdT

The inventors have previously shown that immunization with a fusion conjugate, in which a pneumococcal protein is genetically fused to the pneumococcal pneumolysoid PdT and then covalently coupled to a polysaccharide, can enhance immune responses and protection (Lu Y J et al., Protection against Pneumococcal colonization and fatal pneumonia by a trivalent conjugate of a fusion protein with the cell wall polysaccharide. Infect Immun 2009; 77:2076-83.; Lu et al., A bivalent vaccine to protect against *Streptococcus pneumoniae* and *Salmonella typhi*. Vaccine 2012; 30:3405-12). The inventors next tested some antigens in fusion proteins with PdT and also fusion protein conjugated to the *Salmonella typhi* polysaccharide, Vi (our nomenclature for a fusion protein of protein X and PdT, then conjugated to Vi is X-PdT-Vi). As shown in FIG. 2, immunization with a fusion protein consisting of SP0785-PdT protected 80% mice against sepsis and fusion protein SP2145-PdT protected 90%. The protection is not due to PdT alone, which only protects 30% of the infected mice, not statistically different from the mortality rate of control mice. Fusion proteins SP0785-PdT, SP2145-PdT and SP1500-PdT were conjugated to Vi polysaccharide as described before. These mice made high level of IL-17A when stimulated with whole cell vaccine (WCV) (FIG. 3A), which raises the strong possibility that these two constructs may protect against both pneumococcal colonization and disease. FIG. 3B shows that these fusion conjugates also elicit robust antibodies to the Vi polysaccharide, predicting protection against *S. typhi* as well.

Figure 4:
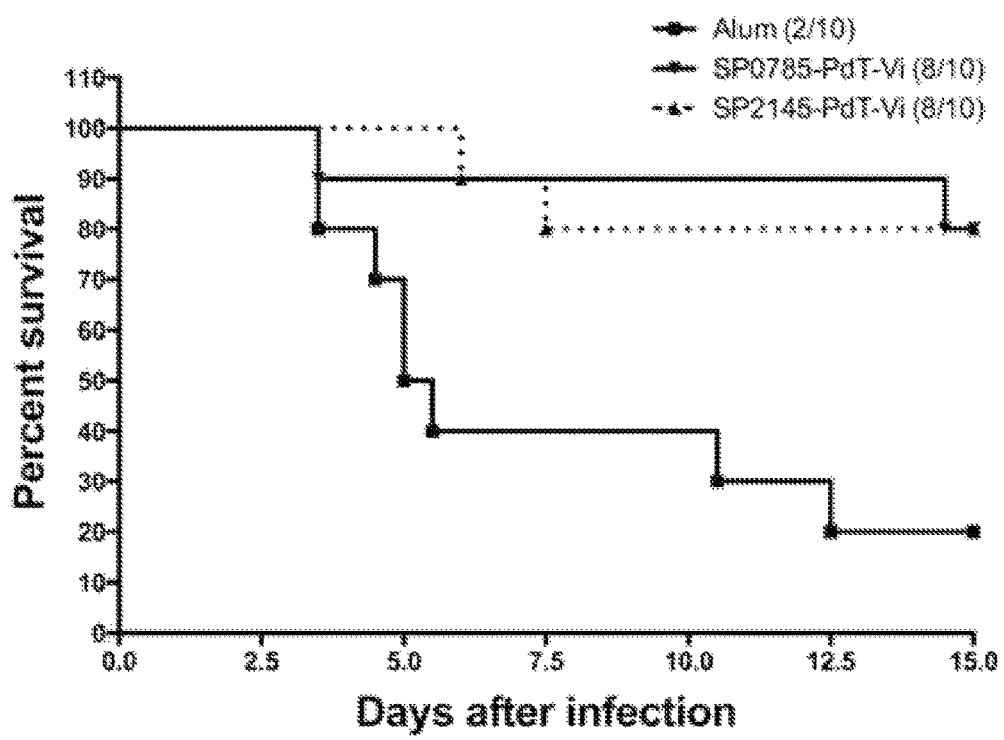
FIG. 4 shows pneumococcal antigens fused to Pdt (pneumococcal pneumolysoid PdT) and covalently conjugated to the Vi polysaccharide protects against sepsis challenge and prevents against invasive infection and nasopharyngeal colonization of pneumococcus.

Similarly to fusion proteins, SP2145-PdT-Vi and SP0785-PdT-Vi significantly protected mice when compared to immunization with alum alone (80% survival in either group compared to 20% survival in alum group, P<0.006 for either comparison; FIG. 4).

Example 6

Sera from Mice Immunized with SP0785 Binds to an Encapsulated Tigr4 Strain

Figure 5:
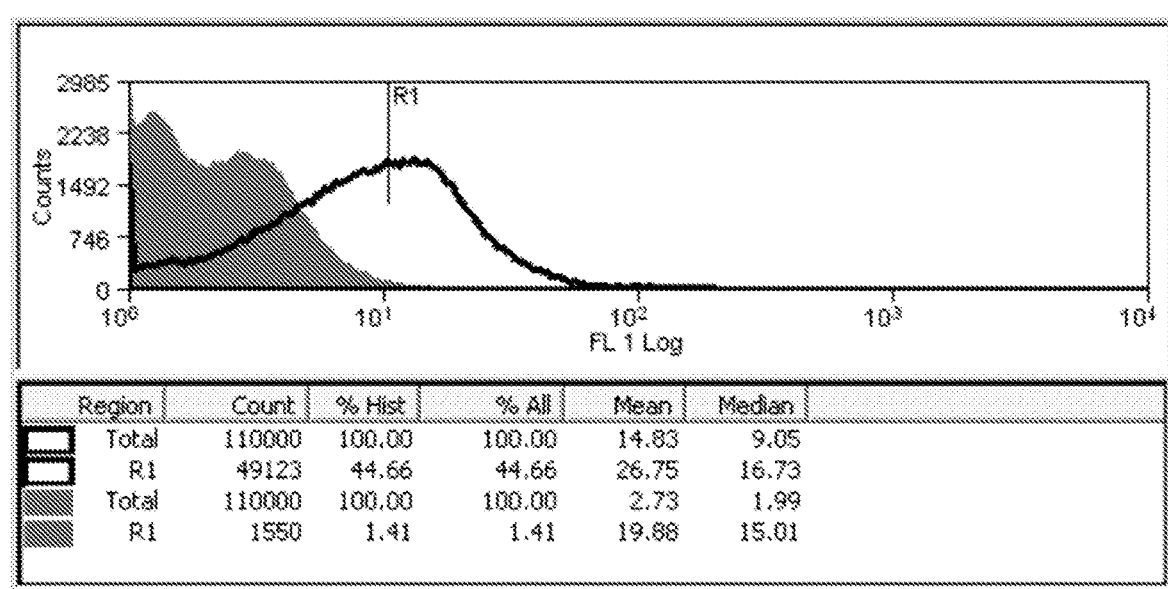
FIG. 5 shows sera from immunized mice bind encapsulated pneumococcal strain Tigr4.

A flow cytometric assay was performed to test whether antibodies against these antigens (SP0785, SP1500, SP2145) can bind to the surface of encapsulated pneumococcal strain. The type 4 clinical isolate TIGR4 strain was cultured to late-log phase and heat fixed. Binding of mouse anti-sera was detected by FITC labeled anti-mouse IgG. As shown in FIG. 5, serum from mice immunized with SP0785 (black) can label the bacteria when compared to serum obtained from mice immunized with alum alone (grey), which indicates that anti-SP0785 antibody is able to bind to encapsulated pneumococcal strain.

In summary, the inventors have identified two proteins SP0785 and SP1500 that protect against pneumococcal colonization, and SP0346 that protects against sepsis. Fusion proteins SP0785-PdT and SP2145-PdT or the conjugation of these two proteins to Vi protected mice against sepsis challenge.

Example 7

Figure 6A:
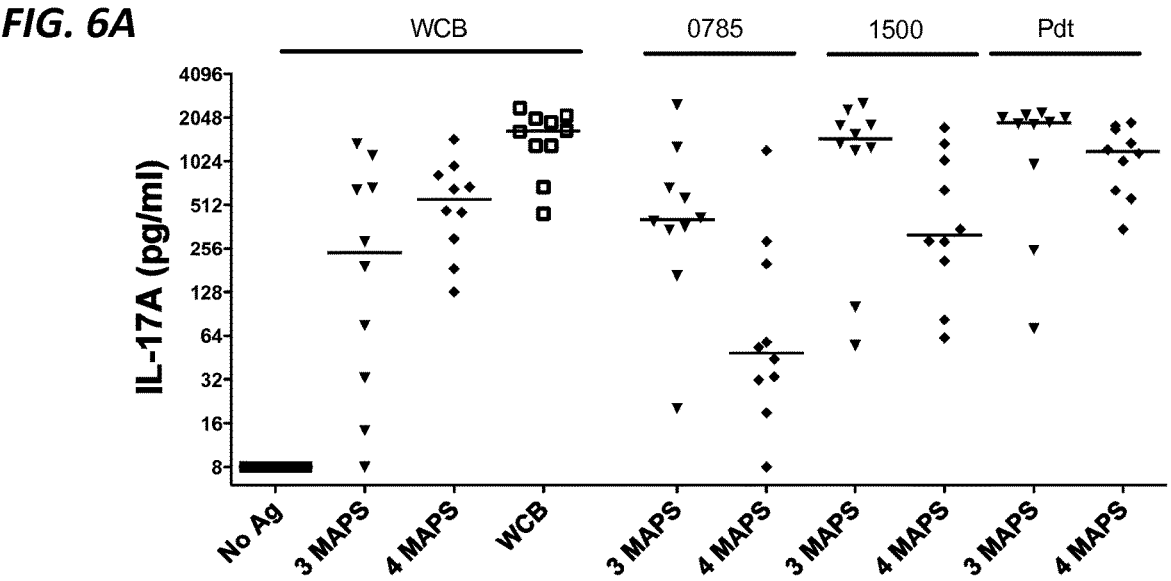
FIGS. 6A-6B demonstrate protection against pneumococcal colonization by a Multiple Antigen Presenting System (MAPS) construct. MAPS complexes were made using biotinylated type-1 pneumococcal polysaccharide attached to a fusion protein consisting of rhizavidin and SP0785, SP1500, SP0435 or PdT. C57/BL6 mice were immunized with a mixture of 3 MAPS complexes containing SP0785, SP1500 and PdT, or a mixture of all 4 MAPS complexes described above, on aluminum hydroxide, at a dosage of 6.7 µg of each antigen. Control mice received either aluminum hydroxide alone (alum, negative control) or a whole cell vaccine in alum (as a positive control). Immunization was given subcutaneously three times, two weeks apart. Blood was drawn after the third immunization and stimulated with 10 µg/ml of *S. pneumoniae* whole cell antigen or 5 µg/ml of purified SP0785, SP1500 or PdT protein. Antigen-specific or whole cell (WCB) IL-17A production was measured 7 days post stimulation by ELISA (FIG. 6A). One week after bleeding, mice were challenged with pneumococcal 603B strain and bacterial colonization rate in the nose was determined 10 days post challenge (FIG. 6B). Mice that received immunizations with either 3 or 4 MAPS complexes were protected against pneumococcal colonization.
Figure 6B:
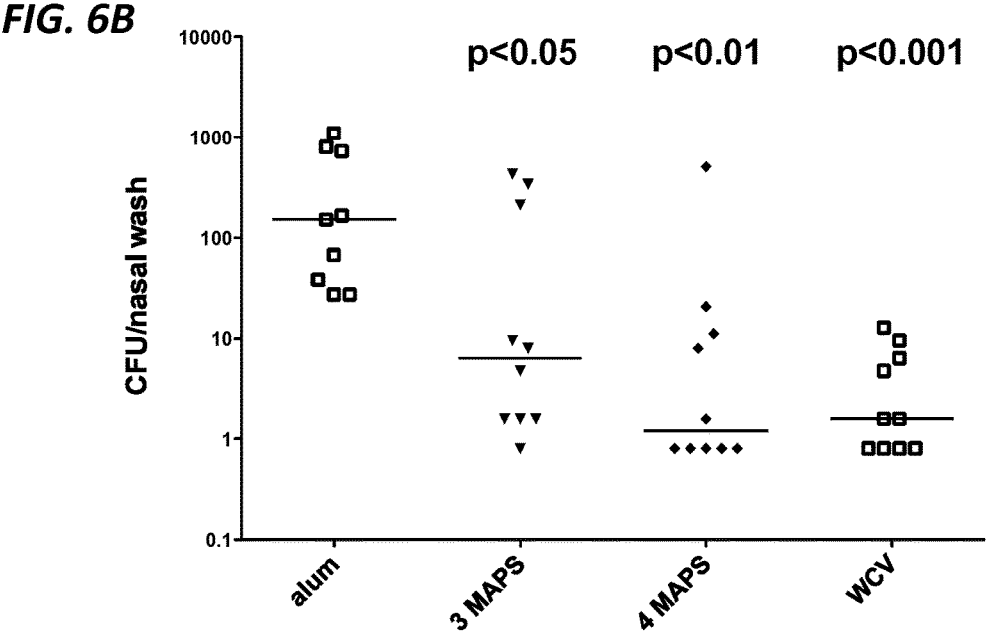

MAPS complexes were made using biotinylated type-1 pneumococcal polysaccharide attached to a fusion protein consisting of rhizavidin and SP0785, SP1500, SP0435 or PdT. C57/BL6 mice were immunized with a mixture of 3 MAPS complexes containing SP0785, SP1500 and PdT, or a mixture of all 4 MAPS complexes described above, on aluminum hydroxide, at a dosage of 6.7 µg of each antigen. Control mice received either aluminum hydroxide alone (alum, negative control) or a whole cell vaccine in alum (as a positive control). Immunization was given subcutaneously three times, two weeks apart. Blood was drawn after the third immunization and stimulated with 10 µg/ml of S. pneumoniae whole cell antigen or 5 µg/ml of purified SP0785, SP1500 or PdT protein. Antigen-specific or whole cell (WCB) IL-17A production was measured 7 days post stimulation by ELISA (FIG. 6A). One week after bleeding, mice were challenged with pneumococcal 603B strain and bacterial colonization rate in the nose was determined 10 days post challenge (FIG. 6B). Mice that received immunizations with either 3 or 4 MAPS complexes were protected against pneumococcal colonization.

Figure 7:
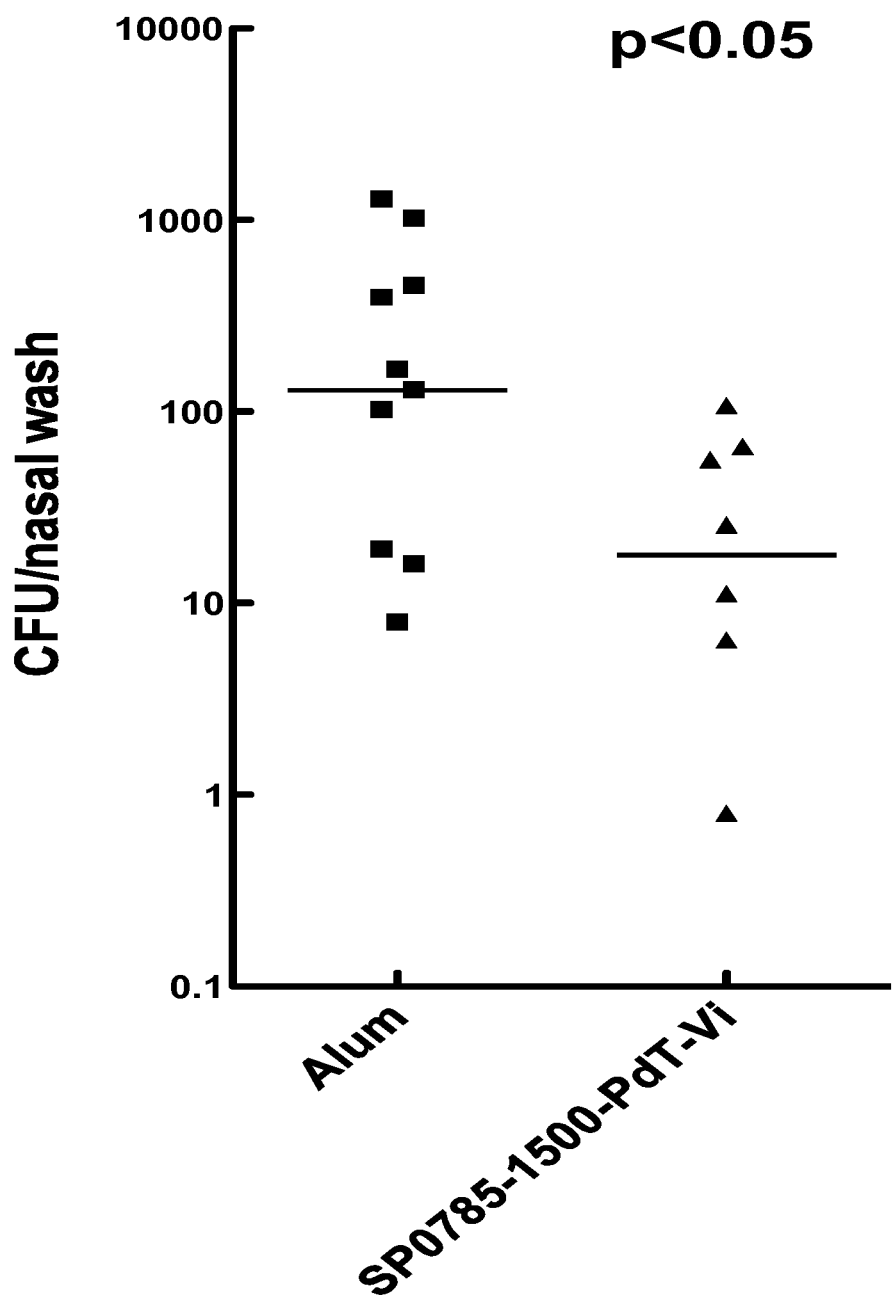
FIG. 7 demonstrates protection against pneumococcal colonization by a fusion protein of SP0785, SP1500 and PdT conjugated to Vi polysaccharide of *Salmonella typhi*. C57BL/6 mice were immunized with vaccines containing 5 µg of protein antigen adsorbed onto alum, subcutaneously three times, two weeks apart. Control mice received alum alone. Two weeks after last immunization, mice were intranasally challenged with pneumococcal 603B strain and bacterial colonization rate in the nose was determined by nasal wash. The mice that were immunized with the fusion conjugate were significantly protected against pneumococcal colonization compared to the mice in the control group.

C57BL/6 mice were immunized with vaccines containing 5 µg of protein antigen (a fusion protein of SP0785, SP1500 and PdT conjugated to Vi polysaccharide of Salmonella typhi) adsorbed onto alum, subcutaneously three times, two weeks apart. Control mice received alum alone. Two weeks after last immunization, mice were intranasally challenged with pneumococcal 603B strain and bacterial colonization rate in the nose was determined by nasal wash. The mice that were immunized with the fusion conjugate were significantly protected against pneumococcal colonization compared to the mice in the control group (FIG. 7).

Figure 8:
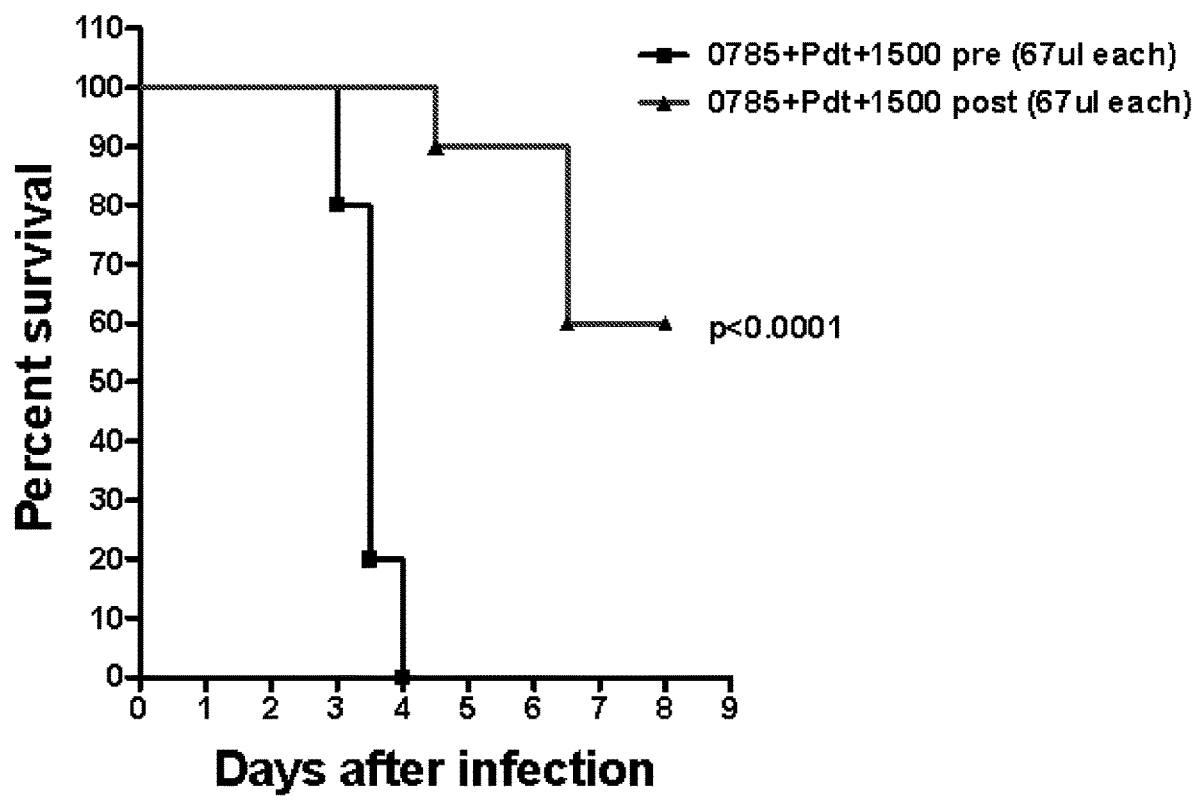
FIG. 8 demonstrates that passive transfer of rabbit serum protects mice against pneumococcal challenge. New Zealand white rabbits were immunized with purified SP0785, SP1500 or PdT. An equal mixture of each serum from rabbits pre-immunization vs. post immunization (in this case, 67 µl each) was given to groups of 10 mice via the intraperitoneal route. Mice were then intraperitoneally infected with a serotype 3 strain 24 hours later and mice survival was monitored for 8 days. Group received post immunization serum had 60% survival comparing to 0% survival in the pre-serum group, a difference that was highly statistically significant, attesting to the protective capacity of antibodies to these proteins for pneumococcal invasive disease.

New Zealand white rabbits were immunized with purified SP0785, SP1500 or PdT. An equal mixture of each serum from rabbits pre-immunization vs. post immunization (in this case, 67 µl each) was given to groups of 10 mice via the intraperitoneal route. Mice were then intraperitoneally infected with a serotype 3 strain 24 hours later and mice survival was monitored for 8 days. Group received post immunization serum had 60% survival comparing to 0% survival in the pre-serum group, a difference that was highly statistically significant, attesting to the protective capacity of antibodies to these proteins for pneumococcal invasive disease (FIG. 8).

REFERENCES

All references described herein are incorporated herein in their entirety by reference.

1. Moffitt K L, Gierahn T M, Lu Y J, et al. T(H)17-Based Vaccine Design for Prevention of Streptococcus pneumoniae Colonization. Cell Host Microbe 2011; 9:158-65.
2. Lu Y J, Forte S, Thompson C M, Anderson P W, Malley R. Protection against Pneumococcal colonization and fatal pneumonia by a trivalent conjugate of a fusion protein with the cell wall polysaccharide. Infect Immun 2009; 77:2076-83.
3. Lu Y J, Zhang F, Sayeed S, et al. A bivalent vaccine to protect against Streptococcus pneumoniae and Salmonella typhi. Vaccine 2012; 30:3405-12.

Sequences:

| Pneumococcal antigen name | Protein SEQ ID NO: | DNA SEQ ID NO: |
|---|---|---|
| SP0010 | SEQ ID NO: 1 | SEQ ID NO: 77 |
| SP0043 | SEQ ID NO: 2 | SEQ ID NO: 78 |
| SP0079 | SEQ ID NO: 3 | SEQ ID NO: 79 |
| SP0084 | SEQ ID NO: 4 | SEQ ID NO: 80 |
| SP0092 | SEQ ID NO: 5 | SEQ ID NO: 81 |
| SP0098 | SEQ ID NO: 6 | SEQ ID NO: 82 |
| SP0106 | SEQ ID NO: 7 | SEQ ID NO: 83 |
| SP0107 | SEQ ID NO: 8 | SEQ ID NO: 84 |
| SP0127 | SEQ ID NO: 9 | SEQ ID NO: 85 |
| SP0149 | SEQ ID NO: 10 | SEQ ID NO: 86 |
| SP0191 | SEQ ID NO: 11 | SEQ ID NO: 87 |
| SP0198 | SEQ ID NO: 12 | SEQ ID NO: 88 |
| SP0249 | SEQ ID NO: 13 | SEQ ID NO: 89 |
| SP0321 | SEQ ID NO: 14 | SEQ ID NO: 90 |
| SP0346 | SEQ ID NO: 15 | SEQ ID NO: 91 |
| SP0402 | SEQ ID NO: 16 | SEQ ID NO: 92 |
| SP0453 | SEQ ID NO: 17 | SEQ ID NO: 93 |
| SP0564 | SEQ ID NO: 18 | SEQ ID NO: 94 |
| SP0582 | SEQ ID NO: 19 | SEQ ID NO: 95 |
| SP0589 | SEQ ID NO: 20 | SEQ ID NO: 96 |
| SP0601 | SEQ ID NO: 21 | SEQ ID NO: 97 |
| SP0604 | SEQ ID NO: 22 | SEQ ID NO: 98 |
| SP0617 | SEQ ID NO: 23 | SEQ ID NO: 99 |
| SP0620 | SEQ ID NO: 24 | SEQ ID NO: 100 |
| SP0629 | SEQ ID NO: 25 | SEQ ID NO: 101 |
| SP0648 | SEQ ID NO: 26 | SEQ ID NO: 102 |
| SP0659 | SEQ ID NO: 27 | SEQ ID NO: 103 |
| SP0662 | SEQ ID NO: 28 | SEQ ID NO: 104 |
| SP0664 | SEQ ID NO: 29 | SEQ ID NO: 105 |
| SP0678 | SEQ ID NO: 30 | SEQ ID NO: 106 |
| SP0724 | SEQ ID NO: 31 | SEQ ID NO: 107 |
| SP0742 | SEQ ID NO: 32 | SEQ ID NO: 108 |
| SP0757 | SEQ ID NO: 33 | SEQ ID NO: 109 |
| SP0785 | SEQ ID NO: 34 | SEQ ID NO: 110 |
| SP0787 | SEQ ID NO: 35 | SEQ ID NO: 111 |
| SP0872 | SEQ ID NO: 36 | SEQ ID NO: 112 |
| SP0878 | SEQ ID NO: 37 | SEQ ID NO: 113 |
| SP0899 | SEQ ID NO: 38 | SEQ ID NO: 114 |
| SP1002 | SEQ ID NO: 39 | SEQ ID NO: 115 |
| SP1026 | SEQ ID NO: 40 | SEQ ID NO: 116 |
| SP1032 | SEQ ID NO: 41 | SEQ ID NO: 117 |
| SP1069 | SEQ ID NO: 42 | SEQ ID NO: 118 |
| SP1154 | SEQ ID NO: 43 | SEQ ID NO: 119 |
| SP1267 | SEQ ID NO: 44 | SEQ ID NO: 120 |
| SP1376 | SEQ ID NO: 45 | SEQ ID NO: 121 |
| SP1386 | SEQ ID NO: 46 | SEQ ID NO: 122 |
| SP1404 | SEQ ID NO: 47 | SEQ ID NO: 123 |
| SP1405 | SEQ ID NO: 48 | SEQ ID NO: 124 |
| SP1419 | SEQ ID NO: 49 | SEQ ID NO: 125 |
| SP1479 | SEQ ID NO: 50 | SEQ ID NO: 126 |
| SP1500 | SEQ ID NO: 51 | SEQ ID NO: 127 |
| SP1545 | SEQ ID NO: 52 | SEQ ID NO: 128 |

-continued

| Pneumococcal antigen name | Protein SEQ ID NO: | DNA SEQ ID NO: |
|---|---|---|
| SP1560 | SEQ ID NO: 53 | SEQ ID NO: 129 |
| SP1624 | SEQ ID NO: 54 | SEQ ID NO: 130 |
| SP1652 | SEQ ID NO: 55 | SEQ ID NO: 131 |
| SP1683 | SEQ ID NO: 56 | SEQ ID NO: 132 |
| SP1826 | SEQ ID NO: 57 | SEQ ID NO: 133 |
| SP1872 | SEQ ID NO: 58 | SEQ ID NO: 134 |
| SP1891 | SEQ ID NO: 59 | SEQ ID NO: 135 |
| SP1897 | SEQ ID NO: 60 | SEQ ID NO: 136 |
| SP1942 | SEQ ID NO: 61 | SEQ ID NO: 137 |
| SP1966 | SEQ ID NO: 62 | SEQ ID NO: 138 |
| SP1967 | SEQ ID NO: 63 | SEQ ID NO: 139 |
| SP1998 | SEQ ID NO: 64 | SEQ ID NO: 140 |
| SP2048 | SEQ ID NO: 65 | SEQ ID NO: 141 |
| SP2050 | SEQ ID NO: 66 | SEQ ID NO: 142 |
| SP2083 | SEQ ID NO: 67 | SEQ ID NO: 143 |
| SP2084 | SEQ ID NO: 68 | SEQ ID NO: 144 |
| SP2088 | SEQ ID NO: 69 | SEQ ID NO: 145 |
| SP2145 | SEQ ID NO: 70 | SEQ ID NO: 146 |
| SP2151 | SEQ ID NO: 71 | SEQ ID NO: 147 |
| SP2187 | SEQ ID NO: 72 | SEQ ID NO: 148 |
| SP2192 | SEQ ID NO: 73 | SEQ ID NO: 149 |
| SP2197 | SEQ ID NO: 74 | SEQ ID NO: 150 |
| SP2207 | SEQ ID NO: 75 | SEQ ID NO: 151 |
| SP2218 | SEQ ID NO: 76 | SEQ ID NO: 152 |

SEQ ID NO: 153/SP0010 (23-end)
SEQ ID NO: 154/SP0043 (42-end)
SEQ ID NO: 155/SP0079 (24-end)
SEQ ID NO: 156/SP0084 (110-end)
SEQ ID NO: 157/SP0092 (30-end)
SEQ ID NO: 158/SP0098 (30-end)
SEQ ID NO: 159/SP0106 (29-end)
SEQ ID NO: 160/SP0107 (30-end)
SEQ ID NO: 161/SP0127 (26-end)
SEQ ID NO: 162/SP0149 (25-end)
SEQ ID NO: 163/SP0191 (26-end)
SEQ ID NO: 164/SP0198 (45-end)
SEQ ID NO: 165/SP0249 (26-end)
SEQ ID NO: 14/SP0321 (1-end)
SEQ ID NO: 166/SP0346 (98-end)
SEQ ID NO: 167/SP0402 (29-end)
SEQ ID NO: 168/SP0453 (25-298)
SEQ ID NO: 169/SP0564 (21-end)
SEQ ID NO: 170/SP0582 (92-end)
SEQ ID NO: 171/SP0589 (36-end)
SEQ ID NO: 172/SP0601 (36-297)
SEQ ID NO: 173/SP0604 (223-end)
SEQ ID NO: 174/SP0617 (44-end)
SEQ ID NO: 175/SP0620 (27-end)
SEQ ID NO: 176/SP0629 (21-end)
SEQ ID NO: 177/SP0648 (40-776)
SEQ ID NO: 178/SP0648 (777-1676)
SEQ ID NO: 179/SP0648 (1677-end)
SEQ ID NO: 180/SP0659 (28-end)
SEQ ID NO: 181/SP0662 (29-276)
SEQ ID NO: 182/SP0662 (300-end)
SEQ ID NO: 183/SP0664 (103-629)
SEQ ID NO: 184/SP0664 (630-1200)
SEQ ID NO: 185/SP0664 (1201-end)
SEQ ID NO: 186/SP0678 (23-end)
SEQ ID NO: 187/SP0724 (35-end)
SEQ ID NO: 188/SP0742 (43-end)
SEQ ID NO: 189/SP0757 (44-451)
SEQ ID NO: 190/SP0785 (33-end)
SEQ ID NO: 191/SP0787 (43-290)
SEQ ID NO: 192/SP0872 (30-end)
SEQ ID NO: 193/SP0878 (245-end)
SEQ ID NO: 194/SP0899 (31-end)
SEQ ID NO: 195/SP1002 (22-end)
SEQ ID NO: 196/SP1026 (24-end)
SEQ ID NO: 197/SP1032 (22-end)
SEQ ID NO: 198/SP1069 (34-end)
SEQ ID NO: 199/SP1154 (155-694)
SEQ ID NO: 200/SP1154 (695-1374)
SEQ ID NO: 201/SP1154 (1375-end)
SEQ ID NO: 202/SP1267 (25-end)
SEQ ID NO: 203/SP1376 (32-end)
SEQ ID NO: 204/SP1386 (33-end)
SEQ ID NO: 205/SP1404 (31-end)
SEQ ID NO: 206/SP1405 (19-end)
SEQ ID NO: 207/SP1419 (27-end)
SEQ ID NO: 208/SP1479 (40-end)
SEQ ID NO: 209/SP1500 (27-end)
SEQ ID NO: 210/SP1545 (29-end)
SEQ ID NO: 211/SP1560 (28-end)
SEQ ID NO: 212/SP1624 (1-217)
SEQ ID NO: 213/SP1652 (62-397)
SEQ ID NO: 214/SP1683 (65-end)
SEQ ID NO: 215/SP1826 (36-end)
SEQ ID NO: 216/SP1872 (40-end)
SEQ ID NO: 217/SP1891 (40-end)
SEQ ID NO: 218/SP1897 (30-end)
SEQ ID NO: 219/SP1942 (37-end)
SEQ ID NO: 220/SP1966 (25-end)
SEQ ID NO: 221/SP1967 (30-end)
SEQ ID NO: 222/SP1998 (51-end)
SEQ ID NO: 223/SP2048 (40-end)
SEQ ID NO: 224/SP2050 (35-end)
SEQ ID NO: 225/SP2083 (192-end)
SEQ ID NO: 226/SP2084 (30-end)
SEQ ID NO: 227/SP2088 (30-end)
SEQ ID NO: 70/SP2145 (1-end)
SEQ ID NO: 228/SP2151 (25-end)
SEQ ID NO: 229/SP2187 (32-end)
SEQ ID NO: 230/SP2192 (224-end)
SEQ ID NO: 231/SP2197 (30-end)
SEQ ID NO: 232/SP2207 (30-end)
SEQ ID NO: 234/SP2218 (106-end)

SEQUENCE LISTING (405 sequences)

SEQ ID NO: 1 - protein, 422 aa, Streptococcus pneumoniae
MRKFLIILLLPSFLTISKVVSTEKEVVYTSKEIYYLSQSDFGIYFREKLSSPMVYGEVPVYANEDLVVESGKLTPKTSFQITEWRLNKQGIPVFKLSNHQFIAADKRFLYDQSEVTPTIKKVWLESDFKLYNSPYDLKEVKSSLSAYSQVSIDKTMFVEGREFLHIDQAGWVAKESTSEEDNRMSKVQEMLSEKYQKDSFSIYVKQLTTGKEAGINQDEKMYAASVLKLSYLYYTQEKINEGLYQLDTTVKYVSAVNDFPGSYKPEGSGSLPKKEDNKEYSLKDLITKVSKESDNVAHNLLGYYISNQSDATFKSKMSAIMGDDWDPKEKLISSKMAGKFMEAIYNQNGFVLESLTKTDFDSQRIAKGVSVKVAHKIGDADEFKHDTGVVYADSPFILSIFTKNSDYDTISKIAKDVYEVLK

SEQ ID NO: 2 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKVTASEDGVLHLNPETSDSSMVAEGALLAQLYPSLEREGKAKLTAYLSSKYVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 3 - protein, 221 aa, Streptococcus pneumoniae
MSDRTIGILGLGIFGSSVLAALAKQDMNIIAIDDHAERINQFEPVLARGVIGDITDEELLRSAGIDTCDTVVVATGENLESSVLAVMHCKSLGVPTVIAKVKSQTAKKVLEKIGADSVISPEYEMGQSLAQTILFHNSVDVFQLDKNVSIVEMKIPQSWAGQSLSKLDLRGKYNLNILGFREQENSPLDVEFGPDDLLKADTYILAVINNQYLDTLVALNS

SEQ ID NO: 4 - protein, 350 aa, Streptococcus pneumoniae
MKLKSYILVGYIISTLLTILVVFWAVQKMLIAKGEIYFLLGMTIVASLVGAGISLFLLLPVFTSLGKLKEHAKRVAAKDFPSNLEVQGPVEFQQLGQTFNEMSHDLQVSFDSLEESEREKGLMIAQLSHDIKTPITSIQATVEGILDGIIKESEQAHYLATIGRQTERLNKLVEELNFLTLNTARNQVETTSKDSIFLDKLLIECMSEFQFLIEQERRDVHLQVIPESARIEGDYAKLSRILVNLVDNAFKYSAPGTKLEVVAKLEKDQLSISVTDEGQGIAPEDLENIFKRLYRVETSRNMKTGGHGLGLAIARELAHQLGGEITVSSQYGLGSTFTLVLNLSGSENKA

SEQ ID NO: 5 - protein, 491 aa, Streptococcus pneumoniae
MKNWKKYAFASASVVALAAGLAACGNLTGNSKKAADSGDKPVIKMYQIGDKPDNLDELLANANKIIEEKVGAKLDIQYLGWGDYGKKMSVITSSGENYDIAFADNYIVNAQKGAYADLTELYKKEGKDLYKALDPAYIKGNTVNGKIYAVPVAANVASSQNFAFNGTLLAKYGIDISGVTSYETLEPVLKQIKEKAPDVVPFAIGKVFIPSDNFDYPVANGLPFVIDLEGDTTKVVNRYEVPRFKEHLKTLHKFYEAGYIPKDVATSDTSFDLQQDTWFVREETVGPADYGNSLLSRVANKDIQIKPITNFIKKNQTTQVANFVISNNSKNKEKSMEILNLLNTNPELLNGLVYGPEGKNWEKIEGKENRVRVLDGYKGNTHMGGWNTGNNWILYINENVTDQQIENSKKELAEAKESPALGFIFNTDNVKSEISAIANTMQQFDTAINTGTVDPDKAIPELMEKLKSEGAYEKVLNEMQKQYDEFLKNKK

SEQ ID NO: 6 - protein, 303 aa, Streptococcus pneumoniae
MRKWTKGFLIFGVVTTVIGFILLFVGIQSDGIKSLLSMSKEPVYDSRTEKLTFGKEVENLEITLHQHTLTITDSFDDQIHISYHPSLSAHHDLITNQNDRTLSLTDKKLSETPFLSSGIGGILHIASSYSSRFEEVILRLPKGRTLKGINISANRGQTTIINASLENATLNTNSYILRIEGSRIKNSKLTTPNIVNIFDTVLTDSQLESTENHFHAENIQVHGKVELTAKDYLRIILDQKESQRINWDISSNYGSIFQFTREKPESRGTELSNPYKTEKTDVKDQLIARSDDNIDLISTPSRR

SEQ ID NO: 7 - protein, 354 aa, Streptococcus pneumoniae
MTQNVESLLVSIVISAYNEEKYLPGLIEDLKNQTYPKEDIEILFINAMSTDGTTAIIQQFIKEDTEFNSIRLYNNPKKNQASGFNLGVKHSVGDLILKIDAHSKVTETFVMNNVAIIQQGEFVCGGPRPTIVEGKGKWAETLHLVEENMFGSSIANYRNSSEDRYVSSIFHGMYKREVFQKVGLVNEQLGRTEDNDIHYRIREYGYKIRYSPSILSYQYIRPTFKKMLHQKYSNGLWIGLTSHVQFKCLSLFHYVPCLFVLSLVFSLALLPITFVFITLLLGAYFLLLSLLTLLTLLKHKNGFLIVMPFILFSIHFAYGLGTIVGLIRGFKWKKEYKRTIIYLDKISQINQNML

SEQ ID NO: 8 - protein, 195 aa, Streptococcus pneumoniae
MKSITKKIKATLAGVAALFAVFAPSFVSAQESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSYTATNGRYIGRYQLTDSYLNGDYSAENQERVADAYVAGRYGSWTAAKNFWLNNGWY

SEQ ID NO: 9 - protein, 227 aa, Streptococcus pneumoniae
MKVLAFDTSSKALSLAILEDKQVLAETTINIKKNHSITLMPAIDFLMASLDWTPKDLDRIVVAEGPGSYTGLRIAVATAKTLAHTLNIELVGMSSLLALVPHQQEGLFVPLMDARRNNVYAGFYENAKPVMAEAHLSFEEVLEKVKGTSQVTFVGEVGPFVEQIQKHLPRTDYKETLPNAANLALLAWDKEADSLHDFVPNYLKRVEAEENWLKNHTESGESYIKRL

SEQ ID NO: 10 - protein, 284 aa, Streptococcus pneumoniae
MKIKKWLGLAALATVAGLALAACGNSEKKADNATTIKIATVNRSGSEEKRWDKIQELVKKDGITLEFTEFTDYSQPNKATADGEVDLNAFQHYNFLNNWNKENGKDLVAIADTYISPIRLYSGLNGSANKYTKVEDIPANGEIAVPNDATNESRALYLLQSAGLIKLDVSGTALATVANIKENPKNLKITELDASQTARSLSSVDAAVVNNTFVTEAKLDYKKSLFKEQADENSKQWYNIIVAKKDWETSPKADAIKKVIAAYHTDDVKKVIEESSDGLDQPVW

SEQ ID NO: 11 - protein, 189 aa, Streptococcus pneumoniae
MKKIVLVSLAFLFVLVGCGQKKETGPATKTEKDTLQSALPVIENAEKNTVVTKTLVLPKSDDGSQQTQTITYKDKTFLSLAIQQKRPVSDELKTYIDQHGVEETQKALLEAEEKDKSIIEARKLAGFKLETKLLSATELQTTTSFDFQVLDVKKASQLEHLKNIGLENLLKNEPSKYISDRLANGATEQ

SEQ ID NO: 12 - protein, 152 aa, Streptococcus pneumoniae
MKLKRFTLSLASLASFSLLVACSQRAQQVQQPVAQQQVQQPAQQNTNTANAGGNQNQAAPVQNQPVAQPTDIDGTYTGQDDGDRITLVVTGTTGTWTELESDGDQKVKQVTLDSANQRMIIGDDVKIYTVNGNQIVVDDMDRDPSDQIVLTK

SEQ ID NO: 13 - protein, 102 aa, Streptococcus pneumoniae
MVKIGLFCAAGFSTGMLVNNMKIAAQSSGVEAEIEAFSQSKLADYAPNIDVALLGPQVAYTLDKSKEICDKCDVPIAVIPMMDYGMLDGKKVLDLALSLISG

SEQ ID NO: 14 - protein, 144 aa, Streptococcus pneumoniae
MKIVLVGHGHFATGIYSSLQLIAGNQENVEAIDFVEGMSADELKQKILLAISNEEEVLILSDLLGGSPFKVSSTIMGENPAKTMNVLSGLNLAMLMEAVFARMAHSFDEVVNKSVVAAQGGVVNGKELFSTDAEEEEEDFESGI

SEQ ID NO: 15 - protein, 481 aa, Streptococcus pneumoniae
MSRRFKKSRSQKVKRSVNIVLLTIYLLLVCFLLFLIFKYNILAFRYLNLVVTALVLLVALVGLLLIIYKKAEKFTIFLLVFSILVSSVSLFAVQQFVGLTNRLNATSNYSEYSISVAVLADSEIENVTQLTSVTAPTGTNNENIQKLLADIKSSQNTDLTVNQSSSYLAAYKSLIAGETKAIVLNSVFENIIESEYPDYASKIKKIYTKGFTKKVEAPKTSKSQSFNIYVSGIDTYGPISSVSRSDVNILMTVNRDTKKILLTTTPRDAYVPIADGGNNQKDKLTHAGIYGVDSSIHTLENLYGVDINYYVRLNFTSFLKLIDLLGGIDVYNDQEFTAHTNGKYYPAGNVHLDSEQALGFVRERYSLADGDRDRGRHQQKVIVAILQKLTSTEVLKNYSTIINSLQDSIQTNMPLETMINLVNAQLESGGNYKVNSQDLKGTGRMDLPSYAMPDSNLYVMEIDDSSLAVVKAAIQDVMEGR

SEQ ID NO: 16 - protein, 204 aa, Streptococcus pneumoniae
MNSFKNFLKEWGLFLLILSLLALSRIFFWSNVRVEGHSMDPTLADGEILFVVKHLPIDRFDIVVAHEEDGNKDIVKRVIGMPGDTIRYENDKLYINDKETDEPYLADYIKRFKDDKLQSTYSGKGFEGNKGTFFRSIAQKAQAFTVDVNYNTNFSFTVPEGEYLLLGDDRLVSSDSRHVGTFKAKDITGEAKFRLWPITRIGTF

SEQ ID NO: 17 - protein, 521 aa, Streptococcus pneumoniae
MRKIYLSIFTSLLLMLGLVNVAQADEYLRIGMEAAYAPFNWTQDDDSNGAVKIDGTNQYANGYDVQIAKKIAKDLGKEPLVVKTKWEGLVPALTSGKIDMIIAGMSPTAERKQEIAFSSSYYTSEPVLLVKKDSAYASAKSLDDFNGAKITSQQGVYLYNLIAQIPGAKKETAMGDFAQMRQALEAGVIDAYVSERPEALTAEAANSKFKMIQVEPGFKTGEEDTAIAIGLRKNDNRISQINASIETISKDDQVALMDRMIKEQPAEATTTEETSSSFFSQVAKILSENWQQLLRGAGITLLISIVGTIIGLIIGLAIGVFRTAPLSENKVIYGLQKLVGWVLNVYIEIFRGTPMIVQSMVIYYGTAQAFGINLDRTLAAIFIVSINTGAYMTEIVRGGILAVDKGQFEAATALGMTHNQTMRKIVLPQVVRNILPATGNEFVINIKDTSVLNVISVVELYFSGNTVATQTYQYFQTFTIIAVIYFVLTFTVTRILRFIERRMDMDTYTTGANQMQTEDLK

SEQ ID NO: 18 - protein, 131 aa, Streptococcus pneumoniae
MSKKLNRKKQLRNGLRRAGAFSSTVTKVVDETKKVVKRAEQSASAAGKAVSKKVEQAVEATKEQAQKVANSVEDFAANLGGLPLDRAKTFYDEGIKSASDFKNWTEKELLALKGIGPATIKKLKENGIKFK

SEQ ID NO: 19 - protein, 333 aa, Streptococcus pneumoniae
MIKTFLSALSVILFSIPIITYSFFPSSNLNIWLSTQPILAQIYAFPLATATMAAILSFLFFFLSFYKKNKQIRFYSGILLLLSLILLLFGTDKTLSSASNKTKTLKLVTWNVANQIEAQHIERIFSHFDADMAIFPELATNIRGEQENQRIKLLFHQVGLSMANYDIFTSPPTNSGIAPVTVIVKKSYGFYTEAKTFHTTRFGTIVLHSRKQNIPDIIALHTAPPLPGLMEIWKQDLNIIHNQLASKYPKAIIAGDFNATMRHGALAKISSHRDALNALPPFERGTWNSQSPKLFNATIDHILLPKNHYYVKDLDIVSFQNSDHRCIFTEITF

SEQ ID NO: 20 - protein, 205 aa, Streptococcus pneumoniae
MGWWRETIDIVKENDPAARTTLEVLLTYPGVKALAAHRLSHFLWKHGFKLLARMYSQFWRFWTQIEIHPGAQIDSGVFIDHGSGLVIGETAIVEKGVLLYHGVTLGGTGKDCGKRHPTVRKGALISAHAQVIGPVEIGENAKVGAAAVVVADVPSDVTVVGIPAKIVRLHGKKDEPVIHEVEEKREYYVNKLEQAKDASHRSSGL

SEQ ID NO: 21 - protein, 459 aa, Streptococcus pneumoniae
MLHNAFAYVTRKFFKSIVIFLIILLMASLSLVGLSIKGATAKASQETFKNITNSFSMQINRRVNQGTPRGAGNIKGEDIKKITENKAIESYVKRINAIGDLTGYDLIETPETKKNLTADRAKRFGSSLMITGVNDSSKEDKFVSGSYKLVEGEHLTNDDKDKILLHKDLAAKHGWKVGDKVKLDSNIYDADNEKGAKETVEVTIKGLFDGHNKSAVTYSQELYENTAITDIHTAAKLYGYTEDTAIYGDATFFVTADKNLDDVMKELNGISGINWKSYTLVKSSSNYPALEQSISGMYKMANLLFWGSLSFSVLLLALLLSLWINARRKEVGILLSIGLKQASILGQFITESILIAIPALVSAYFLANYTARAIGNTVLANVTSGVAKQASKAAQASNLGGGAEVDGFSKTLSSLDISIQTSDFIIIFVLALVLVVLVMALASSNLLRKQPKELLLDGE

SEQ ID NO: 22 - protein, 442 aa, Streptococcus pneumoniae
MKRTGLFAKIFIYTFSIFSVLVICLHLAIYFLFPSTYLSHRQETIGQKATAIAQSLEGKDRQSIEQVLDLYSQTSDIKGTVKGEMTEDKLEVKDSLPLDTDRQTTSLFIEEREVKTQDGGTMILQFLASMDLQKEAEQISLQFLPYTLLASFLISLLVAYIYARTIVAPILEIKRVTRRMMDLDSQVRLRVDSKDEIGNLKEQINSLYQHLLTVIADLHEKNEAILQLEKMKVEFLRGASHELKTPLASLKILIENMRENIGRYKDRDQYLGVALGIVDELNHHVLQILSLSSVQELRDDRETIDLLQMTQNLVKDYALLAKERELQIDNSLTHQQAYLNPSVMKLILSNLISNAIKHSVPGGLVRIGEREGELFIENSCSSEEQEKLAQSFSDNASRKVKGSGMGLFVVKSLLEHEKLAYRFEMEENSLTFFIDFPKVVQD

SEQ ID NO: 23 - protein, 240 aa, Streptococcus pneumoniae
MLERWRDMRWLFRLIGAFFSFVWRLFWRLVWIVVLLCVLAFGLLWYLNGDFQGALKQAERSVKIGQQSIDQWEKTGQLPKLSQTDSHQHSEGRWAQASARIYLDPQMDSRFQEAYLEAIQNWNQTGAFNFELVTESSKADITATEMNDGGTPVAGEAESQTNLLTGQFLSVTVRLNHYYLSNPYYGYSYERLVHTAEHELGHAIGLDHTDEKSVMQPAGSFYGIQEEDVANLRKIYETSE

SEQ ID NO: 24 - protein, 266 aa, Streptococcus pneumoniae
MKKFSLLLAILPFLVACENQATPKETSAQKTIVLATAGDVPPFDYEDKGNLTGFDIEVLKAVDEKLSDYEIQFQRTAWESIFPGLDSGHYQAAANNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 25 - protein, 238 aa, Streptococcus pneumoniae
MKKRYLVLTALLALSLAACSQEKTKNEDGETKTEQTAKADGTVGSKSQGAAQKKAEVVNKGDYYSIQGKYDEIIVANKHYPLSKDYNPGENPTAKAELVKLIKAMQEAGFPISDHYSGFRSYETQTKLYQDYVNQDGKAAADRYSARPGYSEHQTGLAFDVIGTDGDLVTEEKAAQWLLDHAADYGFVVRYLKGKEKETGYMAEEWHLRYVGKEAKEIAASGLSLEEYYGFEGGDYVD

SEQ ID NO: 26 - protein, 2233 aa, Streptococcus pneumoniae
MGKGHWNRKRVYSIRKFAVGACSVMIGTCAVLLGGNIAGESVVYADETLITHTAEKPKEEKMIVEEKADKALETKNIVERTEQSEPSSTEAIASEKKEDEAVTPKEEKVSAKPEEKAPRIESQASNQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLQKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEIARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLIDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKDQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRTNPEASVGVLFGDSGILSKRSVDNLSVGFHEDHGVGVPKSYVIEYYVGKTVPTAPKNPSFVGNEDHVFNDSANWKPVTNLKAPAQLKAGEMNHFSFDKVETYAVRIRMVKADNKRGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKSLLSHKPVAAVKQARLLQVGQALELPTKVPVYFTGKDGYETKDLTVEWEEVPAENLTKAGQFTVRGRVLGSNLVAEITVRVTDKLGETLSDNPNYDENSNQAFASATNDIDKNSHDRVDYLNDGDHSENRRWTNWSPTPSSNPEVSAGVIFRENGKIVERTVTQGKVQFFADSGTDAPSKLVLERYVGPEFEVPTYYSNYQAYDADHPFNNPENWEAVPYRADKDIAAGDEINVTFKAIKAKAMRWRMERKADKSGVAMIEMTFLAPSELPQESTQSKILVDGKELADFAENRQDYQITYKGQRPKVSVEENNQVASTVVDSGEDSFPVLVRLVSESGKQVKEYRIHLTKEKPVSEKTVAAVQEDLPKIEFVEKDLAYKTVEKKDSTLYLGETRVEQEGKVGKERIFTAINPDGSKEEKLREVVEVPTDRIVLVGTKPVAQEAKKPQVSEKADTKPIDSSEASQTNKAQLPSTGSAASQAAVAAGLTLLGLSAGLVVTKGKKED

SEQ ID NO: 27 - protein, 188 aa, Streptococcus pneumoniae
MKKWQTCVLGAGSLLCLTACSGKSVTSEHQTKDEMKTEQTASKTSAAKGKEVADFELMGVDGKTYRLSDYKGKKVYLKFWASWCSICLASLPDTDEIAKEAGDDYVVLTVVSPGHKGEQSEADFKNWYKGLDYKNLPVLVDPSGKLLETYGVRSYPTQAFIDKEGKLVKTHPGFMEKDAILQTLKELA

SEQ ID NO: 28 - protein, 563 aa, Streptococcus pneumoniae
MKRSSLLVRMVISIFLVFLILLALVGTFYYQSSSSAIEATIEGNSQTTISQTSHFIQSYIKKLETTSTGLTQQTDVLAYAENPSQDKVEGIRDLFLTILKSDKDLKTVVLVTKSGQVISTDDSVQMKTSSDMMAEDWYQKAIHQGAMPVLTPARKSDSQWVISVTQELVDAKGANLGVLRLDISYETLEAYLNQLQLGQQGFAFIINENHEFVYHPQHTVYSSSSKMEAMKPYIDTGQGYTPGHKSYVSQEKIAGTDWTVLGVSSLEKLDQVRSQLLWTLLGASVTSLLVCLCLVWFSLKRWIAPLKDLRETMLEIASGAQNLRAKEVGAYELREVTRQFNAMLDQIDQLMVAIRSQEETTRQYQLQALSSQINPHFLYNTLDTIIWMAEFHDSQRVVQVTKSLATYFRLALNQGKDLICLSDEINHVRQYLFIQKQRYGDKLEYEINENVAFDNLVLPKLVLQPLVENALYHGIKEKEGQGHIKLSVQKQDSGLVIRIEDDGVGFQDAGDSSQSQLKRGGVGLQNVDQRLKLHFGANYHMKIDSRPQKGTKVEIYINRIETS

SEQ ID NO: 29 - protein, 1881 aa, Streptococcus pneumoniae
MAPSVVDAATYHYVNKEIISQEAKDLIQTGKPDRNEVVYGLVYQKDQLPQTGTEASVLTAFGLLTVGSLLLIYKRKKIASVFLVGAMGLVVLPSAGAVDPVATLALASREGVVEMEGYRYVGYLSGDILKTLGLDTVLEETSAKPGEVTVVEVETPQSITNQEQARTENQVVETEEAPKEEAPKTEESPKEEPKSEVKPTDDTLPKVEEGKEDSAEPAPVEEVGGEVESKPEEKVAVKPESQPSDKPAEESKVEQAGEPVAPREDEKAPVEPEKQPEAPEEEKAVEETPKQEESTPDTKAEETVEPKEETVNQSIEQPKVETPAVEKQTEPTEEPKVEQAGEPVAPREDEQAPTAPVEPEKQPEVPEEEKAVEETPKPEDKIKGIGTKEPVDKSELNNQIDKASSVSPTDYSTASYNALGPVLETAKGVYASEPVKQPEVNSETNKLKTAIDALNVDKTELNNTIADAKTKVKEHYSDRSWQNLQTEVTKAEKVAANTDAKQSEVNEAVEKLTATIEKLVELSEKPILTLTSTDKKILEREAVAKYTLENQNKTKIKSITAELKKGEEVINTVVLTDDKVTTETISAAFKNLEYYKEYTLSTTMIYDRGNGEETETLENQNIQLDLKKVELKNIKRTDLIKYENGKETNESLITTIPDDKSNYYLKITSNNQKTTLLAVKNIEETTVNGTPVYKVTAIADNLVSRTADNKFEEEYVHYIEKPKVHEDNVYYNFKELVEAIQNDPSKEYRLGQSMSARNVVPNGKSYITKEFTGKLLSSEGKQFAITELEHPLFNVITNATINNVNFENVEIERSGQDNIASLANTMKGSSVITNVKITGTLSGRNNVAGFVNNMNDGTRIENVAFFGKLHSTSGNGSHTGGIAGTNYRGIVRKAYVDATITGNKTRASLLVPKVDYGLTLDHLIGTKALLTESVVKGKIDVSNPVEVGAIASKTWPVGTVSNSVSYAKIIRGEELFGSNDVDDSDYASAHIKDLYAVEGYSSGNRSFRKSKTFTKLTKEQADAKVTTFNITADKLESDLSPLAKLNEEKAYSSIQDYNAEYNQAYKNLEKLIPFYNKDYIVYQGNKLNKEHHLNTKEVLSVTAMNNNEFITNLDEANKIIVHYADGTKDYFNLSSSSEGLSNVKEYTITDLGIKYTPNIVQKDNTTLVNDIKSILESVELQSQTMYQHLNRLGDYRVNAIKDLYLEESFTDVKENLTNLITKLVQNEEHQLNDSPAARQMIRDKVEKNKAALLLGLTYLNRYYGVKFGDVNIKELMLFKPDFYGEKVSVLDRLIEIGSKENNIKGSRTFDAFGQVLAKYTKSGNLDAFLNYNRQLFTNIDNMNDWFIDATEDHVYIAERASEVEEIKNSKHRAFDNLKRSHLRNTILPLLNIDKAHLYLISNYNAIAFGSAERLGKKSLEDIKDIVNKAADGYRNYYDFWYRLASDNVKQRLLRDAVIPIWEGYNAPGGWVEKYGRYNTDKVYTPLREFFGPMDKYYNYNGTGAYAAIYPNSDDIRTDVKYVHLEMVGEYGISVYTHETTHVNDRAIYLGGFGHREGTDAEAYAQGMLQTPVTGSGFDEFGSLGINMVFKRKNDGNQWYITDPKTLKTREDINRYMKGYNDTLTLLDEIEAESVISQQNKDLNSAWFKKIDREYRDNNKLNQWDKIRNLSQEEKNELNIQSVNDLVDQQLMTNRNPGNGIYKPEAISYNDQSPYVGVRMMTGIYGGNTSKGAPGAVSFKHNAFRLWGYYGYENGFLGYASNKYKQQSKTDGESVLSDEYIIKKISNNTFNTIEEFKKAYFKEVKDKATKGLTTFEVNGSSVSSYDDLLTLFKEAVKKDAETLKQEANGNKTVSMNNTVKLKEAVYKKLLQQTNSFKTSIFK

SEQ ID NO: 30 - protein, 126 aa, Streptococcus pneumoniae
MVTWILWALILAMLAWMGFNYLRIRRAAKIVDNEEFEALIRTGQLIDLRDPAEFHRKHILGARNIPSSQLKTSLAALRKDKPVLLYENQRAQRVTNAALYLKKQGFSEIYILSYGLDSWKGKVKTS

SEQ ID NO: 31 - protein, 267 aa, Streptococcus pneumoniae
MQEFTNPFPIGSSSLIHCITNEISCEMLANGILALGCKPVMADDSREVLDFTKQSQALFINLGHLSAEKEKAIRMAASYANQSSLPMVVDAVGVTTSSIRKSLVKDLLDYRPTVLKGNMSEIRSLVGLKHHGVGVDASAKDQETEDLLQVLKDWCQTYPGMSFLVTGPKDLVVSKNQVAVLGNGCTELDWITGTGDLVGALTAVFLSQGKTGFEASCLAVSYLNIAAEKIVVQGMGLEEFRYQVLNQLSLLRRDENWLDTIKGEVYE

SEQ ID NO: 32 - protein, 281 aa, Streptococcus pneumoniae
MTWKIIADSGCDYRQLPTPAINTTFVSVPLTIQVADQVFVDDASLDIDQMMETMYATAEASKSACPSPDDYLRAFEGAKNIFLVTITGTLSGSHNSAQLAKNIYLEDHPDTKIHVIDSLSAGGEVDLLVEKLNDLIDQGLSFEEVVEAITAYQEKTKLLFVLAKVDNLVKNGRLSKLIGTVVGLLNIRMVGKASETGTLELLQKARGSKKSVQAAYDELVKAGYAGGRIVMAQRNNEKCCQQLSERIRETFPQADIKILPTSGLCSFYAEEGGLLMGYEID

SEQ ID NO: 33 - protein, 308 aa, Streptococcus pneumoniae
MISRFFRHLFEALKSLKRNGWMTVAAVSSVMITLTLVAIFASVIFNTAKLATDIENNVRVVVYIRKDVEDNSQTIEKEGQTVTNNDYHKVYDSLKNMSTVKSVTFSSKEEQYEKLTEIMGDNWKIFEGDANPLYDAYIVEANTPNDVKTIAEDAKKIEGVSEVQDGGANTERLFKLASFIRVWGLGIAALLIFIAVFLISNTIRITIISRSREIQIMRLVGAKNSYIRGPFLLEGAFIGLLGAIAPSVLVFIVYQIVYQSVNKSLVGQNLSMISPDLFSPLMIALLFVIGVFIGSLGSGISMRRFLKI

SEQ ID NO: 34 - protein, 399 aa, Streptococcus pneumoniae
MKKKNGKAKKWQLYAAIGAASVVVLGAGGILLFRQPSQTALKDEPTHLVVAKEGSVASSVLLSGTVTAKNEQYVYFDASKGDLDEILVSVGDKVSEGQALVKYSSSEAQAAYDSASRAVARADRHINELNQARNEAASAPAPQLPAPVGGEDATVQSPTPVAGNSVASIDAQLGDARDARADAAAQLSKAQSQLDATTVLSTLEGTVVEVNSNVSKSPTGASQVMVHIVSNENLQVKGELSEYNLANLSVGQEVSFTSKVYPDKKWTGKLSYISDYPKNNGEAASPAAGNNTGSKYPYTIDVTGEVGDLKQGFSVNIEVKSKTKAILVPVSSLVMDDSKNYVWIVDEQQKAKKVEVSLGNADAENQEITSGLTNGAKVISNPTSSLEEGKEVKADEATN

SEQ ID NO: 35 - protein, 419 aa, Streptococcus pneumoniae
MQNLKFAFSSIMAHKMRSLLTMIGIIIGVSSVVVIMALGDSLSRQVNKDMTKSQKNISVFFSPKKSKDGSFTQKQSAFTVSGKEEEVPVEPPKPQESWVQEAAKLKGVDSYYVTNSTNAILTYQDKKVENANLTGGNRTYMDAVKNEIIAGRSLREQDFKEFASVILLDEELSISLFESPQEAINKVVEVNGFSYRVIGVYTSPEAKRSKIYGFGGLPITTNISLAANFNVDEIANIVFRVNDTSLTPTLGPELARKMTELAGLQQGEYQVADESVVFAEIQQSFSFMTTIISSIAGISLFVGGTGVMNIMLVSVTERTREIGLRKALGATRANILIQFLIESMILTLLGGLIGLTIASGLTALAGLLLQGLIEGIEVGVSIPVALFSLAVSASVGMIFGVLPANKASKLDPIEALRYE

SEQ ID NO: 36 - protein, 413 aa, Streptococcus pneumoniae
MKKIFLTLLTVSLLGGASTAVAQDFTIAAKHAIAVEANTGKILYEKDATQPVEIASITKLITVYLVYEALENGSITLSTPVDISDYPYQLTTNSEASNIPMEARNYTVEELLEATLVSSANSAAIALAEKIAGSEKDFVDMMRAKLLEWGIQDATVVNTTGLNNETLGDNIYPGSKKDEENKLSAYDVAIVARNLIKKYPQVLEITKKPSSTFAGMTITSTNYMLEGMPAYRGGFDGLKTGTTDKAGESFVGTTVEKGMRVITVVLNADHQDNNPYARFTATSSLMDYISSTFTLRKIVQQGDAYQDSKAPVQDGKEDTVTAVAPEDIYLIERVGNQSSQSVQFTPDSKAIPAPLEAGTVVGHLTYEDKDLIGQGYITTERPSFEMVADKKIEKAFFLKVWWNQFVRFVNEKL

SEQ ID NO: 37 - protein, 767 aa, Streptococcus pneumoniae
MANKNTSTTRRRPSKAELERKEAIQRMLISLGIAILLIFAAFKLGAAGITLYNLIRLLVGSLAYLAIFGLLIYLFFFKWIRKQEGLLSGFFTIFAGLLLIFEAYLVWKYGLDKSVLKGTMAQVVTDLTGFRTTSFAGGGLIGVALYIPTAFLFSNIGTYFIGSILILVGSLLVSPWSVYDIAEFFSRGFAKWWEGHERRKEERFVKQEEKARQKAEKEARLEQEETEKALLDLPPVDMETGEILTEEAVQNLPPIPEEKWVEPEIILPQAELKFPEQEDDSDDEDVQVDFSAKEALEYKLPSLQLFAPDKPKDQSKEKKIVRENIKILEATFASFGIKVTVERAEIGPSVTKYEVKPAVGVRVNRISNLSDDLALALAAKDVRIEAPIPGKSLIGIEVPNSDIATVSFRELWEQSQTKAENFLEIPLGKAVNGTARAFDLSKMPHLLVAGSTGSGKSVAVNGIIASILMKARPDQVKFMMVDPKMVELSVYNDIPHLLIPVVTNPRKASKALQKVVDEMENRYELFAKVGVRNIAGFNAKVEEFNSQSEYKQIPLPFIVVIVDELADLMMVASKEVEDAIIRLGQKARAAGIHMILATQRPSVDVISGLIKANVPSRVAFAVSSGTDSRTILDENGAEKLLGRGDMLFKPIDENHPVRLQGSFISDDDVERIVNFIKTQADADYDESFDPGEVSENEGEFSDGDAGGDPLFEEAKSLVIETQKASASMIQRRLSVGFNRATRLMEELEIAGVIGPAEGTKPRKVLQQ

SEQ ID NO: 38 - protein, 290 aa, Streptococcus pneumoniae
MKKSRKLATLGICSALFLGLAACQQQHATSEGTNQRQSSSAKVPWKASYTNLNNQVSTEEVKSLLSAHLDPNSVDAFFNLVNDYNTIVGSTGLSGDFTSFTHTEYDVEKISHLWNQKKGDFVGTNCRINSYCLLKNSVTIPKLEKNDQLLFLDNDAIDKGKVFDSQDKEEFDILFSRVPTESTTDVKVHAEKMEAFFSQFQFNEKARMLSVVLHDNLDGEYLFVGHVGVLVPADDGFLFVEKLTFEEPYQAIKFASKEDCYKYLGTKYADYTGEGLAKPFIMDNDKWVKL

SEQ ID NO: 39 - protein, 305 aa, Streptococcus pneumoniae
MKKQNLFLVLLSVFLLCLGACGQKESQTGKGMKIVTSFYPIYAMVKEVSGDLNDVRMIQSSSGIHSFEPSANDIAAIYDADVFVYHSHTLESWAGSLDPNLKKSKVKVLEASEGMTLERVPGLEDVEAGDGVDEKTLYDPHTWLDPEKAGEEAQIIADKLSEVDSEHKETYQKNAQAFIKKAQELTKKFQPKFEKATQKTFVTQHTAFSYLAKRFGLNQLGIAGISPEQEPSPRQLTEIQEFVKTYKVKTIFTESNASSKVAETLVKSTGVGLKTLNPLESDPQNDKTYLENLEENMSILAEELK

SEQ ID NO: 40 - protein, 204 aa, Streptococcus pneumoniae
MFKRIRRVLVLAVFLFAGYKAYRVHQDVKQVMTYQPMVREILSEQDTPANEELVLAMIYTETKGKEGDVMQSSESASGSTNTINDNASSIRQGIQTLTGNLYLAQKKGVDIWTAVQAYNFGPAYIDFIAQNGKENTLALAKQYSRETVAPLLGNRTGKTYSYIHPISIFHGAELYVNGGNYYYSRQVRLNLYIIKCFTLFSTSG

SEQ ID NO: 41 - protein, 341 aa, Streptococcus pneumoniae
MKNKFFLIAILAMCIVFSACSSNSVKNEENTSKEHAPDKIVLDHAFGQTILDKKPERVATIAWGNHDVALALGIVPVGFSKANYGVSADKGVLPWTEEKIKELNGKANLFDDLDGLNFEAISNSKPDVILAGYSGITKEDYDTLSKIAPVAAYKSKPWQTLWRDMIKIDSKALGMEKEGDELIKNTEARISKELEKHPEIKGKIKGKKVLFTMINAADTSKFWIYTSKDPRANYLTDLGLVFPESLKEFESEDSFAKEISAEEANKINDADVIITYGDDKTLEALQKDPLLGKINAIKNGAVAVIPDNTPLAASCTPTPLSINYTIEEYLNLLGNACKNAK

SEQ ID NO: 42 - protein, 344 aa, Streptococcus pneumoniae
MLKEIKRRNRMKNKRLIGIIAALAVLVAGSLIYSSMNKSEAQNNKDEKKITKIGVLQFVSHPSLDLIYKGIQDGLAEEGYKDDQVKIDFMNSEGDQSKVATMSKQLVANGNDLVVGIATPAAQGLASATKDLPVIMAAITDPIGANLVKDLKKPGGNVTGVSDHNPAQQQVELIKALTPNVKTIGALYSSSEDNSKTQVEEFKAYAEKAGLTVETFAVPSTNEIASTVTVMTSKVDAIWVPIDNTIASGFPTVVSSNQSSKKPIYPSATAMVEVGGLASVVIDQHDLGVATGKMIVQVLKGAKPADTPVNVFSTGKSVINKKIAQELGITIPESVLKEAGQVIE

SEQ ID NO: 43 - protein, 2004 aa, Streptococcus pneumoniae
MEKYFGEKQERFSFRKLSVGLVSATISSLFFMSVLASSSVDAQETAGVHYKYVADSELSSEEKKQLVYDIPTYVENDDETYYLVYKLNSQNQLAELPNTGSKNERQALVAGASLAAMGILIFAVSKKKVKNKTVLHLVLVAGIGNGVLVSVHALENHLLLNYNTDYELTSGEKLPLPKEISGYTYIGYIKEGKTTSESEVSNQKSSVATPTKQQKVDYNVTPNFVDHPSTVQAIQEQTPVSSTKPTEVQVVEKPFSTELINPRKEEKQSSDSQEQLAEHKNLETKKEEKISPKEKTGVNTLNPQDEVLSGQLNKPELLYREETMETKIDFQEEIQENPDLAEGTVRVKQEGKLGKKVEIVRIFSVNKEEVSREIVSTSTTAPSPRIVEKGTKKTQVIKEQPETGVEHKDVQSGAIVEPAIQPELPEAVVSDKGEPEVQPTLPEAVVTDKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSKNTGEVSSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEPSNGNSTEDVSTESNTSNSNGNEEIKQENELDPDKKVEEPEKTLELRNVSDLELYSLSNGTYKQHISLEQVPSNPNSYFVKVKSSSFKDVYLPVASISEERKNDKILYKITAKVEKLQQEIESRYKDNFTFYLAKKGTEETTNFTSFSNLVKAINQNPSGTYHLAASLNANEVELGPDERSYIKDTFTGRLIGEKDGKNYAIYNLKKPLFENLSGATVEKLSLKNVAISGKDDIGSLANEAQNNTKIKQVHVDGVLAGERGIGGLLAKAEQSSITESSFKGRIINTYETTAAYNIGGMVGHLTGDKALLTKSKATVAISSNTNTSDQTVGGLAGLVDRDAQIQDSYAEGDINNVKHFGRVAGVAGNLWDRTSGDVRHAGSLTNVLSDVNVTNGNAITGYHYNEMKVKDTFSSKANRVYNVTLVKDEVVSKESFEERGTMLDASQIASKKAEINPLILPTVEPLSTSGKKDSDFSKVAYYQAKRNLTYKNIEKLLPFYNKATIVKYGNLVNENSLLYQKELLSAVMMKDNQVITDIVSNKQTANKLLLHYKDDLSEKLDLKYQNDFAKLAEYSLGNTGLLYTPNQFLYDQTSIIKQVLPDLQKVDYHSEAIRKTLGISPNVKQTELYLEDQFAKTKQQLEDSLKKLLSADAGLASANPVTEGYLVDKIKRNKEALLLGLTYLERWYNFSYGQVNVKDLVLYHLDFFGKGNASPLDTLIELGKSGFNNLLAKNNVDTYGISLASQHGTTDLFSTLEHYRKVFLPNTSNNDWFKSETKAYIVEEKSTIEEVKTKQGLAGTKYSIGVYDRITSATWKYRNMVLPLLTLPERSVFVISTMSSLGFGAYDRYRSSDHKAGKALNDFVEENARETAKRQRDHYDYWYRILDDNAREKLYRNILLYDAYKFGDDNTVGKATEVADFDNPNPAMQHFFGPVGNKVGHNQHGAYATGDAVYYMGYRMLDKDGAITYTHEMTHDSDQDIYLGGYGRRSGLGPEFFAKGLLQAPDHPDDATITINSILKHSKSDSTESRRLQVLDPTTRFNNADDLKQYVHNMFDVVYMLEYLEGNSILKLDTNQKQQLLRKVTNEYHPDPDGNKVYATNVVRNLTVEEVERLRSFNDLIDNNILSSREYASGKYERNGYFTIKLFAPIYAALSNDIGTPGDLMGRRIAYELLAAKGFKDGMVPYISNQYEEEAKQKGKTINLYGKTRGLVTDDLVLEKVFNNQYHTWSEFKKAMYQERQDQFDRLNKVTFNDTTQPWQTFAKKTTSSVDELQKLMDVAVRKDAEHNYYHWNNYNPDIDSEVHKLKRAIFKAYLDQTNDFRSSIFENKK

SEQ ID NO: 44 - protein, 229 aa, Streptococcus pneumoniae
MKAIILAAGLGTRLRPMTENTPKALVQVNQKPLIEYQIEFLKEKGINDIIIIVGYLKEQFDYLKEKYGVRLVFNDKYADYNNFYSLYLVKEELANSYVIDADNYLFKNMFRNDLTRSTYFSVYREDCTNEWFLVYGDDYKVQDIIVDSKAGRILSGVSFWDAPTAEKIVSFIDKAYVSGEFVDLYWDNMVKDNIKELDVYVEELEGNSIYEIDSVQDYRKLEEILKNEN

SEQ ID NO: 45 - protein, 284 aa, Streptococcus pneumoniae
MKLDGYTRLAAVVANPIKHSISPFIHNRAFEATATNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 46 - protein, 356 aa, Streptococcus pneumoniae
MKKIYSFLAGIAAIILVLWGIATHLDSKINSRDSQKLVIYNWGDYIDPELLTQFTEETGIQVQYETFDSNEAMYTKIKQGGTTYDIAIPSEYMINKMKDEDLLVPLDYSKIEGIENIGPEFLNQSFDPGNKFSIPYFWGTLGIVYNETMVDEAPEHWDDLWKPEYKNSIMLFDGAREVLGLGLNSLGYSLNSKDLQQLEETVDKLYKLTPNIKAIVADEMKGYMIQNNVAIGVTFSGEASQMLEKNENLRYVVPTEASNLWFDNMVIPKTVKNQNSAYAFINFMLKPENALQNAEYVGYSTPNLPAKELLPEETKEDKAFYPDVETMKHLEVYEKFDHKWTGKYSDLFLQFKMYRK

SEQ ID NO: 47 - protein, 92 aa, Streptococcus pneumoniae
MNKQYSYPLDLSWSTEELASVLSFFNDVEAAYEGKVEAKKLLDSYKGFKAVVPSKSEEKRLGREFETVSGYSLYRAVQAAKEKGEGKISLGK

SEQ ID NO: 48 - protein, 133 aa, Streptococcus pneumoniae
MITLFLSPSCTSCRKAKAWLEKHKVPFVEHNIMTSPLTRKELQHILSLTENGTDDIISTRSKIFQKLNIDVESISVSELLHLIEQYPSLLRRPIIIDAKRMQIGFNEDEIRAFLPRSYRKQELKEARMRAGIS

SEQ ID NO: 49 - protein, 183 aa, Streptococcus pneumoniae
MKSIGTQILQTERLILRRFVESDAEAMFQNWASSAENLTYVTWDPHPDVEITRNSICNWVASYTNLNYYKWAICLKENPEQVIGDISIVKIDEADLSCEIGYVLGKAYWGNGMMTETLKAILDFCFTQAGFQKVRARYASLNPASGRVMEKAGMSYLQTIVNGVERKGYLADLIYYGISREEC

SEQ ID NO: 50 - protein, 463 aa, Streptococcus pneumoniae
MNKSRLGRGRHGKTRHVLLALIGILAISICLLGGFIAFKIYQQKSFEQKIESLKKEKDDQLSEGNQKEHFRQGQAEVIAYYPLQGEKVISSVRELINQDVKDKLESKDNLVFYYTEQEESGLKGVVNRNVTKQIYDLVAFKIEETEKTSLGKVHLTEDGQPFTLDQLFSDASKAKEQLIKELTSFIEDKKIEQDQSEQIVKNFSDQDLSAWNFDYKDSQIILYPSPVVENLEEIALPVSAFFDVIQSSYLLEKDAALYQSYFDKKHQKVVALTFDDGPNPATTPQVLETLAKYDIKATFFVLGKNVSGNEDLVKRIKSEGHVVGNHSWSHPILSQLSLDEAKKQITDTEDVLTKVLGSSSKLMRPPYGAITDDIRNSLDLSFIMWDVDSLDWKSKNEASILTEIQYQVANGSIVLMHDIHSPTVNALPRVIEYLKNQGYTFVTIPEMLNTRLKAHELYYSRDE

SEQ ID NO: 51 - protein, 278 aa, Streptococcus pneumoniae
MKKWMLVLVSLMTALFLVACGKNSSETSGDNWSKYQSNKSITIGFDSTFVPMGFAQKDGSYAGFDIDLATAVFEKYGITVNWQPIDWDLKEAELTKGTIDLIWNGYSATDERREKVAFSNSYMKNEQVLVTKKSSGITTAKDMTGKTLGAQAGSSGYADFEANPEILKNIVANKEANQYQTFNEALIDLKNDRIDGLLIDRVYANYYLEAEGVLNDYNVFTVGLETEAFAVGARKEDTNLVKKINEAFSSLYKDGKFQEISQKWFGEDVATKEVKEGQ

SEQ ID NO: 52 - protein, 143 aa, Streptococcus pneumoniae
MTILFVVISGSFLYMVSLSMKPYQTAKSEGEKLAQQYAGLEQADQVDLYNGLESYYSVLGRNKQQEALAVLIGKDDHKIYVYQLNQGVSQEKAETVSKEKGAGEIDKITFGRYQDKPIWEVKSGSDFYLVDFETGALVNKEGL

SEQ ID NO: 53 - protein, 259 aa, Streptococcus pneumoniae
MKKNSLYIISSLFFACVLFVYATATNFQNSTSARQVKTETYTNTVTNVPIDIRYNSDKYFISGFASEVSVVLTGANRLSLASEMQESTRKFKVTADLTDAGVGTIEVPLSIEDLPNGLTAVATPQKITVKIGKKAQKDKVKIVPEIDPSQIDSRVQIENVMVSDKEVSITSDQETLDRIDKIIAVLPTSERITGNYSGSVPLQAIDRNGVVLPAVITPFDTIMKVTTKPVAPSSSTSNSSTSSSSETSSSTKATSSKTN

SEQ ID NO: 54 - protein, 249 aa, Streptococcus pneumoniae
MFYTYLRGLVVLLLWSINGNAHYHNTDKIPNQDENYILVAPHRTWWDPVYMAFATKPKQFIFMAKKELFTNRIFGWWIRMCGAFPIDRENPSASAIKYPINVLKKSDRSLIMFPSGSRHSNDVKGGAALIAKMAKVRIMPVTYTGPMTLKGLISRERVDMNFGNPIDISDIKKMNDEGIETVANRIQTEFQRLDEETKQWHNDKKPNPLWWFIRIPALILAIILAILTIIFSFIASFIWNPDKKREELA

SEQ ID NO: 55 - protein, 924 aa, Streptococcus pneumoniae
MPVSRMWCSTSILRILTVWSTSMIKRKTYWKDLVQSFTGSKGRFLSILILMMLGSLALVGLKVTSPNMEATANAYLTTAQTLDLAVMSNYGLDQADQEELKQTEGAEVEFGYLTDVTMDNGQDAIRLYSKPERISTFQLRKGRLPQSDKEIALATHLQGQYSVGQEISFKEKEEGHSSLKDHTYTITGFVDSAEILSQRDMGYAGSGSGTLTAYGVILPSQFDQKVYNIARLKYQDLAGLNAFSSAYEEKSKQHQEELEQILSDNGKVRLQLLKKEGQESLDKGQETLDKAQTNLQEGKRRLAAAQARIQAQESQLALFPQVQREQASAQLTQAKQELGKEEDKLKQAEQNLAQEKEKLEKHQQVLDDLAEPRYQVYNRQTMPGGQGYLMYSNASSSIRAVGNIFPVVLYAVAAMVTFTTMTRFVDEERTHAGIFKALGYRSKDIIAKFLLYGLVAGTVGTALGSILGHYLLASVISSVITKGMVVGETQIQFYWTYSLLAFVLSLLASVLPAYLVAWRELHDEAAQLLLPKPPVKGAKILLERIGFIWRRLSFTHKVTARNIFRYKQRMLMTIFGVAGSVALLFAGLGIQSSVAGVPSKQFQQIQQYQMLVSENPSATNQDKVELAEVLKGQEILAYQKIYSKALYKDFKGKAGLQNITLMMIEKEDLTPFIHLQHHQQELTLKDGIVITAKLAQLAGVKVGQTLEIEGKELKVVAITENYVGHFIYMSQASYEQLYGQLPQANTYLVSLRDTSATSIESQAGLLMNQSAVSSVVQNASAIRLFDSIASSLNQTMTILVIVSVLLAIVILYNLTNINVAERIRELSTIKVLGFHNNEVTLYIYRETIVLSLVGIVLGLIAGFYLHQFLIQMISPATILFYPQVGWEVYVIPVAAVSIILTLLGFFVNYYLRKVDMLEALKSVE

SEQ ID NO: 56 - protein, 442 aa, Streptococcus pneumoniae
MKFRKLACTVLAGAAVLGLAACGNSGGSKDAAKSGGDGAKTEITWWAFPVFTQEKTGDGVGTYEKSIIEAFEKANPDIKVKLETIDFKSGPEKITTAIEAGTAPDVLFDAPGRIIQYGKNGKLAELNDLFTDEFVKDVNNENIVQASKAGDKAYMYPISSAPFYMAMNKKMLEDAGVANLVKEGWTTDDFEKVLKALKDKGYTPGSLFSSGQGGDQGTRAFISNLYSGSVTDEKVSKYTTDDPKFVKGLEKATSWIKDNLINNGSQFDGGADIQNFANGQTSYTILWAPAQNGIQAKLLEASKVEVVEVPFPSDEGKPALEYLVNGFAVFNNKDDKKVAASKKFIQFIADDKEWGPKDVVRTGAFPVRTSFGKLYEDKRMETISGWTQYYSPYYNTIDGFAEMRTLWFPMLQSVSNGDEKPADALKAFTEKANETIKKAMKQ

SEQ ID NO: 57 - protein, 355 aa, Streptococcus pneumoniae
MKKMKVWSTVLATGVALTTLAACSGGSNSTTASSSEEKADKSQELVIYSNSVSNGRGDWLTAKAKEAGFNIKMVDIAGAQLADRVIAEKNNAVADMVFGIGAVDSNKIRDQKLLVQYKPKWLDKIDQSLSDKDNYYNPVIVQPLVLIGAPDVKEMPKDWTELGSKYKGKYSISGLQGGTGRAILASILVRYLDDKGELGVSEKGWEVAKEYLKNAYTLQKGESSIVKMLDKEDPIQYGMMWGSGALVGQKEQNVVFKVMTPEIGVPFVTEQTMVLSTSKKQALAKEFIDWFGQSEIQVEYSKNFGSIPANKDALKDLPEDTKKFVDQVKPQNIDWEAVGKHLDEWVEKAELEYVQ

SEQ ID NO: 58 - protein, 321 aa, Streptococcus pneumoniae
MKTSLKLYFTALVASFLLLLGACSTNSSTSQTETSSSAPTEVTIKSSLDEVKLSKVPEKIVTFDLGAADTIRALGFEKNIVGMPTKTVPTYLKDLVGTVKNVGSMKEPDLEAIAALEPDLIIASPRTQKFVDKFKEIAPTVLFQASKDDYWTSTKANIESLASAFGETGTQKAKEELTKLDKSIQEVATKNESSDKKALAILLNEGKMAAFGAKSRFSFLYQTLKFKPTDTKFEDSRHGQEVSFESVKEINPDILFVINRTLAIGGDNSSNDGVLENALIAETPAAKNGKIIQLTPDLWYLSGGGLESTKLMIEDIQKALK

SEQ ID NO: 59 - protein, 659 aa, Streptococcus pneumoniae
MKKNRVFATAGLVLLAAGVLAACSSSKSSDSSAPKAYGYVYTADPETLDYLISSKNSTTVVTSNGIDGLFTNDNYGNLAPAVAEDWEVSKDGLTYTYKIRKGVKWFTSDGEEYAEVTAKDFVNGLKHAADKKSEAMYLAENSVKGLADYLSGTSTDFSTVGVKAVDDYTLQYTLNQPEPFWNSKLTYSIFWPLNEEFETSKGSDFAKPTDPTSLLYNGPFLLKGLTAKSSVEFVKNEQYWDKENVHLDTINLAYYDGSDQESLERNFTSGAYSYARLYPTSSNYSKVAEEYKDNIYYTQSGSGIAGLGVNIDRQSYNYTSKTTDSEKVATKKALLNKDFRQALNFALDRSAYSAQINGKDGAALAVRNLFVKPDFVSAGEKTFGDLVAAQLPAYGDEWKGVNLADGQDGLFNADKAKAEFAKAKKALEADGVQFPIHLDVPVDQASKNYISRIQSFKQSVETVLGVENVVVDIQQMTSDEFLNITYYAANASSEDWDVSGGVSWGPDYQDPSTYLDILKTTSSETTKTYLGFDNPNSPSVVQVGLKEYDKLVDEAARETSDLNVRYEKYAAAQAWLTDSSLFIPAMASSGAAPVLSRIVPFTGASAQTGSKGSDVYFKYLKSQDKVVTKEEYEKAREKWLKEKAESNEKAQKELASHVK

SEQ ID NO: 60 - protein, 419 aa, Streptococcus pneumoniae
MEWYKKIGLLATTGLALFGLGACSNYGKSADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 61 - protein, 338 aa, Streptococcus pneumoniae
MVKKIIGMVLALLSVTVVGVGVFAYTIYQQGTETLAKTYKKIGEETKVIEATEPLTILLMGVDTGNVERTETWVGRSDSMILMTVNPKTKKTTMMSLERDILTRIESGNGQAHEAKLNSAYADGGAELAIETIQKMMNIHIDRYVMVNMRGLQKLVDAVGGITVNNILGFPISISDQEEFNTISIGVGEQHIGGEEALVYARMRYQDPEGDYGRQKRQREVIQKVMEKALSLNSIGHYQEILKALSDNMQTNIDLSAKSIPNLLGYKDSFKTIETQQLQGEGEILQGVSYQIVSRAHMLEMQNLLRRSLGQEEVTQLETNAVLFEDLFGRAPVGDEDN

SEQ ID NO: 62 - protein, 427 aa, Streptococcus pneumoniae
MDKIVVQGGDNRLVGSVTIEGAKNAVLPLLAATILASEGKTVLQNVPILSDVFIMNQVVGGLNAKVDFDEEAHLVKVDATGDITEEAPYKYVSKMRASIVVLGPILARVGHAKVSMPGGCTIGSRPIDLHLKGLEAMGVKISQTAGYIEAKAERLHGAHIYMDFPSVGATQNLMMAATLADGVTVIENAAREPEIVDLAILLNEMGAKVKGAGTETITITGVEKLHGTTHNVVQDRIEAGTFMVAAAMTGGDVLIRDAVWEHNRPLIAKLLEMGVEVIEEDEGIRVRSQLENLKAVHVKTLPHPGFPTDMQAQFTALMTVAKGESTMVETVFENRFQHLEEMRRMGLHSEIIRDTARIVGGQPLQGAEVLSTDLRASAALILTGLVAQGETVVGKLVHLDRGYYGFHEKLAQLGAKIQRIEASDEDE

SEQ ID NO: 63 - protein, 345 aa, Streptococcus pneumoniae
MKKKIRWPLYVIAALIVTFLAFVVPLPYYIEVPGGSEDIRQVLKVNDTEDKEAGAYQFVTVGVQHATLAHMIYAWLTPFTDIRSAQETTGGSSDVEFMRINQFYMQTSQNMAKYQGLKTAGKDIELKYFGVYVLNVTDNSTFKGILNISDTVTAVNDQTFDSSKDLIDYVSSQKLGDSVKVTYEEDGQTKSAEGKIITLENGKNGIGIGLIDRTEVISNVPISFSTAGIGGPSAGLMFSLAIYTQIAHPDLRNGRIVAGTGTIDRDGNVGDIGGIDKKVVASARAGAAIFFAPDNPVSEEEQKAHPDAKNNYQTALEAAKTIKTDMKIVPVKTLQDAIDYLKNNP

SEQ ID NO: 64 - protein, 320 aa, Streptococcus pneumoniae
MPKKILVLHTGGTISMQADASGAVVTSSDNPMNHVSNPLEGIQVHALDFFNLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVSTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 65 - protein, 153 aa, Streptococcus pneumoniae
MVQNSCWQSKSHKVKAFTLLESLLALIVISGGLLLFQAMSQLLISEVRYQQQSEQKEWLLFVDQLEVELDRSQFEKVEGNRLYMKQDGKDIAIGKSKSDDFRKTNARGRGYQPMVYGLKSVRITEDNQLVRFHFQFQKGLEREFIYRVEKEKS

SEQ ID NO: 66 - protein, 134 aa, Streptococcus pneumoniae
MIKAFTMLESLLVLGLVSILALGLSGSVQSTFSAVEEQIFFMEFEELYRETQKRSVASQQKTSLNLDGQTLSNGSQKLPVPKGIQAPSGQSITFDRAGGNSSLAKVEFQTSKGAIRYQLYLGNGKIKRIKETKN

SEQ ID NO: 67 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 68 - protein, 291 aa, Streptococcus pneumoniae
MKFKKMLTLAAIGLSGFGLVACGNQSAASKQSASGTIEVISRENGSGTRGAFTEITGILKKDGDKKIDNTAKTAVIQNSTEGVLSAVQGNANAIGYISLGSLTKSVKALEIDGVKASRDTVLDGEYPLQRPFNIVWSSNLSKLGQDFISFIHSKQGQQVVTDNKFIEAKTETTEYTSQHLSGKLSVVGSTSVSSLMEKLAEAYKKENPEVTIDITSNGSSAGITAVKEKTADIGMVSRELTPEEGKSLTHDAIALDGIAVVVNNDNKASQVSMAELADVFSGKLTTWDKIK

SEQ ID NO: 69 - protein, 216 aa, Streptococcus pneumoniae
MRNQFDLELHELEQSFLGLGQLVLETASKALLALASKDKEMAELIINKDHAINQGQSAIELTCARLLALQQPQVSDLRFVISIMSSCSDLERMGDHMAGIAKAVLQLKENQLAPDEEQLHQMGKLSLSMLADLLVAFPLHQASKAISIAQKDEQIDQYYYALSKEIIGLMKDQETSIPNGTQYLYIIGHLERFADYIANICERLVYLETGELVDLN

SEQ ID NO: 70 - protein, 694 aa, Streptococcus pneumoniae
MKPLLETIDTRFGTTNKHAFSRGNTLPYTGVPFGMNYFVPQTSDQDGSWFFDPHLPIFQGIRLTHQPSPWIGDYSWLLLTPVTSQLGGDSLFHRQSSYDIDKACFQPHYLKLFSLRYQIETQLTPTCYGASIRLNQKQGKALSLYLHAADELTVEQVDKRTLALRQEGKTETNKNSLTMFTALQMNTDILAISQEAGDWRIDLASSQTEMQLATSFISPSQALINLPQEDFDSCKSSAQVDWENLLHRFDIIETGEADRTFFDHCLYRLFLFPQTFYEINESGQAIHMDLATGTVKPGVLFSNNGFWDTFRTTFPLFALIIPEHYQRFLEGFLNSYRDTGFLPKWLAPDERGMMPGTLLDGIIADSACKDMTPDLEGELFQAMLETASKADPLGINGRHGLAQYQELGYLSTDHHESVSHTLDYAYSDFCIASCAKKLENIEIAETYKAASQNYRQLFDAETGYMRARDNQGNFHPDFSPYSWGRDYAECSAIQATLGVLHDIPGLIQLMGGKETFSNYLLKACQDAPLFETTGYGYEIHEMSEMATAPFGQIAISNQPSFHIPYLFRYSDYPDYTALLIKTLRQKAFHPSWEAYPGDEDNGSLSAWYIWSALGFYPTCPGKPSYDLGIPLFDHLRVYLAKEDKWLDIHTKQNHNHFNFVKECRLDKTLVSTIQHQDLLKAEQLTFTLSWLPSH

SEQ ID NO: 71 - protein, 315 aa, Streptococcus pneumoniae
MANRKIVVALGGNAILSSDPSAKAQQEALVETAKHLVKLIKNGDDLIITHGNGPQVGNLLLQHLASDSEKNPAFPLDSLVAMTEGSIGFWLKNALQNALLDEGIEKNVASVVTQVVVDKNDPAFVNLSKPIGPFYSEEEAKAEAEKSGATFKEDAGRGWRKVVASPKPVDIKEIETIRTLLNNGQVVVAAGGGGIPVVKENNGHLTGVEAVIDKDFASQRLAELVDADLFIVLTGVDYVFVNYNKPNQEKLEHVNVAQLEEYIKQDQFAPGSMLPKVEAAIAFVNGRPEGKAVITSLENLGALIESESGTIIEKG

SEQ ID NO: 72 - protein, 475 aa, Streptococcus pneumoniae
MYLGDLMEKAECGQFSILSFLLQESQTTVKAVMEETGFSKATLTKYVTLLNDKALDSGLELAIHSEDENLRLSIGAATKGRDIRSLFLESAVKYQILVYLLYHQQFLAHQLAQELVISEATLGRHLAGLNQILSEFDLSIQNGRWRGPEHQIHYFYFCLFRKVWSSQEWEGHMQKPERKQEIANLEEICGASLSAGQKLDLVLWAHISQQRLRVNACQFQVIEEKMRGYFDNIFYLRLLRKVPSFFAGQHIPLGVEDGEMMIFFSFLLSHRILPLHTMEYILGFGGQLADLLTQLIQEMKKEELLGDYTEDHVTYELSQLCAQVYLYKGYILQDRYKYQLENRHPYLLMEHDFKETAEEIFHALPAFQQGTDLDKKILWEWLQLIEYMAENGGQHMRIGLDLTSGFLVFSRMAAILKRYLEYNRFITIEAYDPSRHYDLLVTNNPIHKKEQTPVYYLKNDLDMEDLVAIRQLLFT

SEQ ID NO: 73 - protein, 443 aa, Streptococcus pneumoniae
MIKNPKLLTKSFLRSFAILGGVGLVIHIAIYLTFPFYYIQLEGEKFNESARVFTEYLKTKTSDEIPSLLQSYSKSLTISAHLKRDIVDKRLPLVHDLDIKDGKLSNYIVMLDMSVSTADGKQVTVQFVHGVDVYKEAKNILLLYLPYTFLVTIAFSFVFSYFYTKRLLNPLFYISEVTSKMQDLDDNIRFDESRKDEVGEVGKQINGMYEHLLKVIYELESRNEQIVKLQNQKVSFVRGASHELKTPLASLRIILENMQHNIGDYKDHPKYIAKSINKIDQMSHLLEEVLESSKFQEWTECRETLTVKPVLVDILSRYQELAHSIGVTIENQLTDATRVVMSLRALDKVLTNLISNAIKYSDKNGRVIISEQDGYLSIKNTCAPLSDQELEHLFDIFYHSQIVTDKDESSGLGLYIVNNILESYQMDYSFLPYEHGMEFKISL

SEQ ID NO: 74 - protein, 335 aa, Streptococcus pneumoniae
MKKTWKVFLTLVTALVAVVLVACGQGTASKDNKEAELKKVDFILDWTPNTNHTGLYVAKEKGYFKEAGVDVDLKLPPEESSSDLVINGKAPFAVYFQDYMAKKLEKGAGITAVAAIVEHNTSGIISRKSDNVSSPKDLVGKKYGTWNDPTELAMLKTLVESQGGDFEKVEKVPNNDSNSITPIANGVFDTAWIYYGWDGILAKSQGVDANFMYLKDYVKEFDYYSPVIIANNDYLKDNKEEARKVIQAIKKGYQYAMEHPEEAADILIKNAPELKEKRDFVIESQKYLSKEYASDKEKWGQFDAARWNAFYKWDKENGILKEDLTDKGFTNEFVK

SEQ ID NO: 75 - protein, 220 aa, Streptococcus pneumoniae
MKCLLCGQTMKTVLTFSSLLLLRNDDSCLCSDCDSTFERIGEENCPNCMKTELSTKCQDCQLWCKEGVEVSHRAIFTYNQAMKDFFSRYKFDGDFLLRKVFASFLSEELKKYKEYQFVVIPLSPDRYANRGFNQVEGLVEAAGFEYLDLLEKREERASSSKNRSERLGTELPFFIKSGVTIPKKILLIDDIYTTGATINRVKKLLEEAGAKDVKTFSLVR

SEQ ID NO: 76 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 77 - DNA, 1269 bp, Streptococcus pneumoniae
atgcgtaaattcttaattattttgttgctaccaagttttttgaccatttcaaaagtcgttagcacagaaaaagaagtcgtctatacttcgaaagaaatttattacctttcacaatctgactttggtatttattttagagaaaaattaagttctcccatggtttatggagaggttcctgtttatgcgaatgaagatttagtagtggaatctgggaaattgactcccaaaacaagttttcaaataaccgagtggcgcttaaataaacaaggaattccagtatttaagctatcaaatcatcaatttatagctgcggacaaacgatttttatatgatcaatcagaggtaactccaacaataaaaaaagtatggttagaatctgactttaaactgtacaatagtccttatgatttaaaagaagtgaaatcatccttatcagcttattcgcaagtatcaatcgacaagaccatgtttgtagaaggaagagaatttctacatattgatcaggctggatgggtagctaaagaatcaacttctgaagaagataatcggatgagtaaagttcaagaaatgttatctgaaaaatatcagaaagattctttctctatttatgttaagcaactgactactggaaaagaagctggtatcaatcaagatgaaaagatgtatgcagccagcgttttgaaactctcttatctctattatacgcaagaaaaaataaatgagggtctttatcagttagatacgactgtaaaatacgtatctgcagtcaatgattttccaggttcttataaaccagagggaagtggtagtcttcctaaaaaagaagataataaagaatattctttaaaggatttaattacgaaagtatcaaaagaatctgataatgtagctcataatctattgggatattacatttcaaaccaatctgatgccacattcaaatccaagatgtctgccattatgggagatgattgggatccaaaagaaaaattgatttcttctaagatggccgggaagtttatggaagctatttataatcaaaatggatttgtgctagagtctttgactaaaacagattttgatagtcagcgaattgccaaaggtgtttctgttaaagtagctcataaaattggagatgcggatgaatttaagcatgatacgggtgttgtctatgcagattctccatttattctttctattttcactaagaattctgattatgatacgatttctaagatagccaaggatgtttatgaggttctaaaatga

SEQ ID NO: 78 - DNA, 1350 bp, Streptococcus pneumoniae
atgaaaccagaatttttagaaagtgcggagttttataatcgtcgttaccataatttttccagtagtgtgattgtacccatggcccttctgcttgtgtttttacttggctttgcaactgttgcagagaaggagatgagtttgtccactagagctactgtcgaacctagtcgtatccttgcaaatatccagtcaactagcaacaatcgtattcttgtcaatcatttggaagaaaataagctggttaagaagggggatcttttggttcaataccaagaaggggcagagggtgtccaagcggagtcctatgccagtcagttggacatgctaaaggatcaaaaaaagcaattggagtatctgcaaaagagcctgcaagaaggggagaaccactttccagaggaggataagtttggctaccaagccacctttcgcgactacatcagtcaagcaggcagtcttagggctagtacatcgcaacaaaatgagaccatcgcgtcccagaatgcagcagctagccaaacccaagccgaaatcggcaacctcatcagtcaaacagaggctaaaattcgcgattaccagacagctaagtcagctattgaaacaggtgcttccttggccggtcagaatctagcctactctctttaccagtcctacaagtctcagggcgaggaaaatccccaaactaaggttcaggcagttgcacaggttgaagcacagatttctcagttagaatctagtcttgctacttaccgtgtccagtatgcaggttcaggtacccagcaagcctatgcgtcagggttaagcagtcaattggaatcccttaaatcccaacacttggcaaaggttggtcaggaattgacccttctagcccagaaaattttggaggcagagtcaggtaagaaggtacagggaaatcttttagacaaggggaaagttacggcgagtgaggatggggtgcttcatcttaatcctgagaccagtgattctagcatggttgcagaaggtgccctactagcccaactttatccatctttggaaagagaagggaaagccaaactcacagcttatctaagttcaaaatatgtagcaagaatcaaggtcggtgattctgttcgctatactacgactcatgatgccgggaatcaacttttcctagattctactattacaagtattgatgcgacagctactaagactgagaaagggaatttctttaaaatcgaggcggagactaatctaacttcggagcaggctgaaaaacttaggtacggggtggaaggccgcttgcagatgattacgggcaagaaaagttacctacgttattatttggatcaatttttgaacaaagagtaa

SEQ ID NO: 79 - DNA, 666 bp, Streptococcus pneumoniae
atgtcagatcgtacgattggaattttgggcttgggaatttttgggagcagtgtcctagctgccctagccaagcaggatatgaatattatcgctattgatgaccacgcagagcgcatcaatcagtttgagccagttttggcgcgtggagtgattggtgacatcacagatgaagaattattgagatcagcagggattgatacctgcgataccgttgtagtcgcgacaggtgaaaatctggagtcgagtgtgcttgcggttatgcactgtaagagtttgggggtaccgactgttattgctaaggtcaaaagtcagaccgctaagaaagtgctagaaaagattggagctgactcggttatctcgccagagtatgaaatggggcagtctctagcacagaccattcttttccataatagtgttgatgtctttcagttggataaaaatgtgtctatcgtggagatgaaaattcctcagtcttgggcaggtcaaagtctgagtaaattagacctccgtggcaaatacaatctgaatattttgggtttccgagagcaggaaaattccccattggatgttgaatttggaccagatgacctcttgaaagcagatacctatattttggcagtcatcaacaaccagtatttggataccctagtagcattgaattcgtaa

SEQ ID NO: 80 - DNA, 1053 bp, Streptococcus pneumoniae
atgaaactaaaaagttatattttggttggatatattatttcaaccctcttaaccattttggttgttttttgggctgttcaaaaaatgctgattgcgaaaggcgagatttactttttgcttgggatgaccatcgttgccagccttgtcggtgctgggattagtctctttctcctattgccagtctttacgtcgttgggcaaactcaaggagcatgccaagcgggtagcggccaaggattttccttcaaatttggaggttcaaggtcctgtagaatttcagcaattagggcaaacttttaatgagatgtcccatgatttgcaggtaagctttgattccttggaagaaagcgaacgagaaaagggcttgatgattgcccagttgtcgcatgatattaagactcctatcacttcgatccaagcgacggtagaagggattttggatgggattatcaaggagtcggagcaagctcattatctagcaaccattggacgccagacggagaggctcaataaactggttgaggagttgaattttttgaccctaaacacagctagaaatcaggtggaaactaccagtaaagacagtatttttctggacaagctcttaattgagtgcatgagtgaatttcagtttttgattgagcaggagagaagagatgtccacttgcaggtaatcccagagtctgcccggattgagggagattatgctaagctttctcgtatcttggtgaatctggtcgataacgcttttaaatattctgctccaggaaccaagctggaagtggtggctaagctggagaaggaccagctttcaatcagtgtgaccgatgaagggcagggtattgccccagaggatttggaaaatattttcaaacgcctttatcgtgtcgaaacttcgcgtaacatgaagacaggtggtcatggattaggacttgcgattgcgcgtgaattggcccatcaattgggtggggaaatcacagtcagcagccagtacggtctaggaagtacctttaccctcgttctcaacctctctggtagtgaaaataaagcctaa

SEQ ID NO: 81 - DNA, 1476 bp, Streptococcus pneumoniae
atgaaaaactggaaaaaatatgcttttgcatctgctagtgtagtcgctctggctgcaggtcttgctgcttgtggaaatttgacaggtaacagcaaaaaagctgctgattcaggtgacaaacctgttatcaaaatgtaccaaatcggtgacaaaccagacaacttggatgaattgttagcaaatgccaacaaaatcattgaagaaaaagttggtgccaaattggatatccaataccttggctggggtgactatggtaagaaaatgtcagttatcacatcatctggtgaaaactatgatattgcctttgcagataactatattgtaaatgctcaaaaaggtgcttacgctgacttgacagaattgtacaaaaaagaaggtaaagacctttacaaagcacttgacccagcttacatcaagggtaatactgtaaatggtaagatttacgctgttccagttgcagccaacgttgcatcatctcaaaactttgccttcaacggaactctccttgctaaatatggtatcgatatttcaggtgttacttcttacgaaactcttgagccagtcttgaaacaaatcaaagaaaaagctccagacgtagtaccatttgctattggtaaagttttcatcccatctgataattttgactacccagtagcaaacggtcttccattcgttatcgaccttgaaggcgatactactaaagttgtaaaccgttacgaagtgcctcgtttcaaagaacacttgaagactcttcacaaattctatgaagctggctacattccaaaagacgtcgcaacaagcgatacttcctttgaccttcaacaagatacttggttcgttcgtgaagaaacagtaggaccagctgactacggtaacagcttgctttcacgtgttgccaacaaagatatccaaatcaaaccaattactaacttcatcaagaaaaaccaaacaacacaagttgctaactttgtcatctcaaacaactctaagaacaaagaaaaatcaatggaaatcttgaacctcttgaatacgaacccagaactcttgaacggtcttgtttacggtccagaaggcaagaactgggaaaaaattgaaggtaaagaaaaccgtgttcgcgttcttgatggctacaaaggaaacactcacatgggtggatggaacactggtaacaactggatcctttacatcaacgaaaacgttacagaccaacaaatcgaaaattctaagaaagaattggcagaagctaaagaatctccagcgcttggatttatcttcaatactgacaatgtgaaatctgaaatctcagctattgctaacacaatgcaacaatttgatacagctatcaacactggtactgtagacccagataaagcgattccagaattgatggaaaaattgaaatctgaaggtgcctacgaaaaagtattgaacgaaatgcaaaaacaatacgatgaattcttgaaaaacaaaaaataa

SEQ ID NO: 82 - DNA, 912 bp, Streptococcus pneumoniae
atgcgtaaatggacaaaaggatttctcatctttggtgtggtgactaccgttatcggctttatcctgctttttgtaggtatccaatctgacgggattaagagcctactttccatgtccaaagaacctgtctatgatagccgtacggaaaagctaacctttggcaaggaagtcgaaaacctagaaattactctccaccaacacacgctcaccatcacagactctttcgatgatcaaatccacatttcttaccatccatctctttctgctcaccatgatcttatcaccaatcagaacgatagaactctgagtctcactgataagaaactgtctgaaactccgtttctctcttctggaattggtgggattcttcatatcgcaagtagctactctagtcgttttgaagaagttattctccgactaccaaaagggagaactctaaaagggatcaacatctcagccaatcgcggacaaaccaccatcataaatgctagccttgaaaatgcgaccctcaatacaaacagctatatcctccgaattgaaggaagtcgtatcaaaaacagtaaactcacaacgcccaatatcgttaatatctttgatacagttcttacagatagtcagctagagtcaacagagaatcacttccacgctgaaaatatccaagtccatggcaaggttgaactgactgccaaagattatctcagaatcatcctagaccagaaagaaagccaacgaattaactgggacatctcaagcaactatggttctatcttccaattcacaagagaaaagcctgaatcaagaggtacggaattaagcaacccttacaaaactgaaaaaaccgatgtcaaggatcaactcattgcgagatctgatgataatattgatctaatatccacaccaagcagacgttga

SEQ ID NO: 83 - DNA, 1065 bp, Streptococcus pneumoniae
gtgactcaaaatgttgaaagtcttctcgtatccattgtaatcagtgcatacaatgaagaaaaatatctgcctggtctaattgaagacttaaaaaatcaaacctatcctaaagaggatattgaaattctatttataaatgctatgtccacagatgggaccacagctatcattcagcaatttataaaggaagatacagagtttaactcaattagattgtataacaatcctaagaaaaatcaagctagtggttttaacctgggagttaaacattctgtaggggaccttattttaaaaattgatgctcattcaaaagttactgagacttttgtaatgaacaatgtggctattattcaacaaggtgaatttgtctgtggggggcctagaccgacgattgtcgaaggaaaaggaaaatgggcagagaccttgcatcttgttgaggaaaatatgtttggcagtagcattgccaattatcgaaatagttctgaggatagatatgtttcttctatttttcatggaatgtataaacgagaggttttccagaaggttggtttagtaaatgagcaacttggccgaactgaagataatgatattcattatagaattcgagaatatggttataaaatccgctatagcccaagtattctatcttatcagtatattcgaccaacattcaagaaaatgctgcatcaaaagtattcaaatggtttgtggattggcttgacaagtcatgttcagtttaagtgtttatcattatttcactatgttccttgtttatttgttttgagtcttgtgtttagtctagcattgttaccgatcacattcgtattcataactttactattaggtgcctattttctacttttgtcattactcactttgctgactttattaaaacataaaaatggatttctaattgtgatgccctttattttattttccattcactttgcttatggccttgggacgattgtaggtttaattagaggatttaaatggaagaaggagtacaagagaacaataatttatttggataaaataagccaaataaatcaaaatatgctataa

SEQ ID NO: 84 - DNA, 588 bp, Streptococcus pneumoniae
atgaaatcaataactaaaaagattaaagcaactcttgcaggagtagctgccttgtttgcagtatttgctccatcatttgtatctgctcaagaatcatcaacttacactgttaaagaaggtgatacactttcagaaatcgctgaaactcacaacacaacagttgaaaaattggcagaaaacaaccacattgataacattcatttgatttatgttgatcaagagttggttatcgatggccctgtagcgcctgttgcaacaccagcgccagctacttatgcggcaccagccgctcaagatgaaactgtttcagctccagtagcagaaactccagtagtaagtgaaacagttgtttcaactgtaagcggatctgaagcagaagccaaagaatggatcgctcaaaaagaatcaggtggtagctatacagctacaaatggacgttatatcggacgttaccaattaacagattcatacctgaacggtgactactcagctgaaaaccaagaacgtgtagcagatgcctacgttgcaggacgttacggttcatggactgctgctaaaaacttctggcttaacaatggctggtattaa

SEQ ID NO: 85 - DNA, 684 bp, Streptococcus pneumoniae
atgaaagtattagcttttgatacgtccagcaaggctctttctctggctattttagaggataagcaggttcttgccgagacgacgattaatattaagaaaaatcacagtattactcttatgcctgccatcgattttttgatggcaagtttggattggacacccaaggatttggaccgaatcgtggtagctgaagggccgggtagctatacaggcttgcgaattgcggtagcaactgctaagaccttagctcacaccctgaacatcgagttggttggtatgtcgagtctcttggctctggtgccccatcaacaagaaggtttgtttgtccccttgatggatgcgcgtcgcaataatgtttatgcaggattttatgaaaatgccaaacctgtcatggcagaagcgcacctatcttttgaagaggtgctagaaaaagtcaagggtactagtcaggtaacctttgtcggagaagttggcccctttgttgagcagattcaaaaacacttgccaaggactgattacaaagaaacattgcccaatgcagctaatctagctcttttggcctgggacaaggaagcagactccttgcatgattttgtgccgaattacctcaaacgagtcgaggctgaggaaaactggctcaagaaccataccgagtctggcgagtcttacattaaacgcctatga

SEQ ID NO: 86 - DNA, 855 bp, Streptococcus pneumoniae
atgaaaatcaaaaaatggcttggtctagcagcccttgctacagtcgcaggtttggctcttgcagcttgcggaaactcagaaaagaaagcagacaatgcaacaactatcaaaatcgcaactgttaaccgtagcggttctgaagaaaaacgttgggacaaaatccaagaattggttaaaaaagacggaattaccttggaatttacagagttcacagactactcacaaccaaacaaagcaactgctgatggcgaagtagatttgaacgctttccaacactataacttcttgaacaactggaacaaagaaaacggaaaagaccttgtagcgattgcagatacttacatctctccaatccgcctttactcaggtttgaatggaagtgccaacaagtacactaaagtagaagacatcccagcaaacggagaaatcgctgtaccgaatgacgctacaaacgaaagccgtgcgctttatttgcttcaatcagctggcttgattaaattggatgtttctggaactgctcttgcaacagttgccaacatcaaagaaaatccaaagaacttgaaaatcactgaattggacgctagccaaacagctcgttcattgtcatcagttgacgctgccgttgtaaacaataccttcgttacagaagcaaaattggactacaagaaatcacttttcaaagaacaagctgatgaaaactcaaaacaatggtacaacatcattgttgcaaaaaaagattgggaaacatcacctaaggctgatgctatcaagaaagtaatcgcagcttaccacacagatgacgtgaaaaaagttatcgaagaatcatcagatggtttggatcaaccagtttggtaa

SEQ ID NO: 87 - DNA, 570 bp, Streptococcus pneumoniae
atgaaaaaaatagttcttgttagtctagctttcctttttgtcctggttggttgcggacagaaaaaagaaactggaccagctacaaaaacagaaaaagatacgcttcagtcggcattgccagttattgaaaatgctgagaagaatacagttgtaactaagactttggtcttgcccaagtcagatgatggtagccagcagacacaaacaattacttacaaagacaagacttttttgagtctagctatccaacaaaaacgtccagtctctgatgagttgaagacttatattgaccaacatggagtggaggaaactcaaaaagctcttcttgaagcggaggagaaggataagtctatcattgaagctcgtaaattggcaggtttcaaacttgaaacaaaactattgagcgcaacggaacttcaaacaacgactagttttgattttcaagttctggatgtcaagaaggcttcccagttggaacatctgaagaatattggtttggaaaatcttttgaaaaatgaaccaagcaaatatatttcagatagattggcaaatggcgcgacagaacaatag

SEQ ID NO: 88 - DNA, 459 bp, Streptococcus pneumoniae
atgaaattaaaaagattcacactttctcttgcttctctagcaagttttagtctcttagtagcttgttcacaaagagctcaacaggttcaacagcctgttgctcagcagcaggtccaacaacctgctcaacagaataccaatactgcaaatgcaggaggtaaccaaaatcaagcggctccagtacaaaaccaacctgttgctcaaccgaccgatattgatgggacttatactggtcaggatgacggagaccgtatcactttagtggtaactggaacgactggtacatggactgagctcgaatctgacggggatcagaaagtcaaacaggttacattggattcagcaaatcaacgcatgattattggcgatgatgtcaaaatttacactgtaaacggtaatcaaatcgtcgtagatgatatggatagagacccatcggaccaaatcgttttaactaaataa

SEQ ID NO: 89 - DNA, 309 bp, Streptococcus pneumoniae
atggtgaagattggtttgttttgtgcagcaggtttttctactggtatgcttgtaaataatatgaaaattgcagcgcaatctagtggagttgaggcagaaatagaggcgttttctcagtctaaattagcggattatgcgccaaatatagatgttgcactattgggtccacaagttgcttatacattagataaatcaaaagaaatttgtgataagtgtgatgttccgatagctgttattccgatgatggactatggtatgttagatgggaaaaaagtattagatttggccctatctttgattagtgggtaa

SEQ ID NO: 90 - DNA, 435 bp, Streptococcus pneumoniae
atgaaaattgtacttgtagggcatggacattttgctacagggatttatagttctttacaattgattgcaggtaatcaagaaaatgtggaggcgattgactttgtggaaggaatgtcagcagatgaactcaagcaaaaaatcttacttgcaatttcaaatgaagaagaagttttaatcctaagtgatctcttgggaggatcgccattcaaggtttcttctaccataatgggagaaaatccagccaagacaatgaatgttctctcgggtttgaacttagccatgttaatggaagcagtctttgctagaatggctcatagctttgatgaggttgttaataaatcagtagtggcggcccagggcggagtcgtaaatggtaaagaattgttttcaacggatgcagaggaagaggaagaagatttcgaatcgggtatttaa

SEQ ID NO: 91 - DNA, 1446 bp, Streptococcus pneumoniae
atgagtagacgttttaaaaaatcacgttcacagaaagtgaagcgaagtgttaatatagttttgctgactatttatttattgttagtttgttttttattgttcttaatctttaagtacaatatccttgcttttagatatcttaatctagtggtaactgcgttagtcctactagttgccttggtagggctactcttgattatctataaaaaagctgaaaagtttactatttttctgttggtgttctctatccttgtcagctctgtgtcgctctttgcagtacagcagtttgttggactgaccaatcgtttaaatgcgacttctaattactcagaatattcaatcagtgtcgctgttttagcagatagtgagatcgaaaatgttacgcaactgacgagtgtgacagcaccgactgggactaataatgaaaatattcagaaattactagctgatatcaagtcaagtcagaataccgatttgacggtcaaccagagttcgtcttacttggcagcttacaagagtttgattgcaggggagactaaggccattgtcctaaatagtgtctttgaaaacatcatcgagtcagagtatccagactacgcatcgaagataaaaaagatttatactaagggattcactaaaaaagtagaagctcctaagacgtctaagagtcagtctttcaatatctatgttagtggaattgacacctatggtcctattagttcggtgtcgcgatcagatgtcaacatcctgatgactgtcaatcgagataccaagaaaatcctcttgaccacaacgccacgtgatgcctatgtaccaatcgcagatggtggaaataatcaaaaagataaattgactcatgcgggcatttatggagttgattcgtccattcacaccttagaaaatctctatggagtggatatcaattactatgtgcgattgaacttcacttcgtttttgaaattgattgatttgttgggtggaattgatgtttataatgatcaagaatttactgcccatacgaatggaaagtattaccctgcaggcaatgttcatcttgattcagaacaggctctcggttttgttcgtgagcgctactccctagcagatggcgatcgtgaccgcgggcgccatcaacaaaaggtgattgtggctatccttcaaaaattaacgtcaaccgaagtgctgaaaaattatagtacgatcattaatagcttgcaagattctatccaaacaaatatgccacttgagaccatgataaatttggtcaatgctcagttagaaagtggagggaattataaagtaaattctcaagatttaaaagggacaggtcggatggatcttccttcttatgcaatgccagacagtaacctctatgtgatggaaatagatgatagtagtttagctgtagttaaagcagctatacaggatgtgatggagggtagatga

SEQ ID NO: 92 - DNA, 615 bp, Streptococcus pneumoniae
atgaattcatttaaaaatttcttaaaagagtggggattgttcctcctaattctgtcattactagctttaagtcgtatctttttttggagcaatgttcgcgtagaaggacattccatggatccgaccctagcggatggcgaaattctcttcgttgtaaaacaccttcctattgaccgttttgatatcgtggtggcccatgaggaagatggcaataaggacatcgtcaagcgcgtgattggaatgcctggcgacaccattcgttacgaaaatgataaactctacatcaatgacaaagaaacggacgagccttatctagcagactatatcaaacgcttcaaggatgacaaactccaaagcacttactcaggcaagggctttgaaggaaataaaggaactttctttagaagtatcgctcaaaaagctcaagccttcacagttgatgtcaactacaacaccaactttagctttactgttccagaaggagaataccttctcctcggagatgaccgcttggtttcgagcgacagccgccacgtaggtaccttcaaagcaaaagatatcacaggggaagctaaattccgcttatggccaatcacccgtatcggaacattttaa

SEQ ID NO: 93 - DNA, 1566 bp, Streptococcus pneumoniae
atgagaaaaatatacttatctattttcacaagtctcttgctgatgctaggacttgtcaatgttgctcaagccgatgaatatttacgcatcggtatggaagcagcatatgctccctttaactggacccaggatgatgatagcaacggagctgtcaaaatcgatgggaccaatcagtatgccaacggatacgatgttcaaatcgccaagaaaatcgctaaggacttaggtaaagaacctttggttgttaaaaccaagtgggaaggtctagtccctgcccttacttctggtaagattgacatgattatcgcaggtatgagtccaactgcagaacgcaaacaagaaattgccttttcgagcagttactatactagcgaaccagttttgcttgtcaaaaaagattctgcctacgcaagtgctaaatctttggatgactttaacggtgcaaaaatcacttctcaacaaggggtctacctttataacttgattgcacaaatcccaggtgctaaaaaagaaacagccatgggagacttcgctcaaatgcgacaagctcttgaggctggtgtcattgatgcttatgtttctgaacgtccagaagcactgactgctgaagctgcgaactctaagttcaagatgattcaagtagaacctggtttcaaaactggggaagaagatacagctatcgctatcgggcttcgtaaaaatgacaatcgtattagccaaatcaatgccagcattgaaaccatttcaaaagatgaccaagttgccttgatggatcgtatgatcaaggaacaacctgccgaagctacaacaactgaagagactagcagtagtttctttagccaagttgctaaaattctttctgaaaactggcaacaactcttgcgtggtgctggtatcactcttttaatctctatcgtcggaaccatcataggtctcattattggacttgccattggtgtcttccgtactgctcctctctctgaaaacaaagtcatttacggcctacaaaaactagtcggctgggttctcaatgtctacattgaaattttccgtggtacgccaatgattgttcaatcgatggttatctactatggaactgcccaagctttcgggatcaaccttgaccgtacactggctgctatcttcatcgtttcaatcaataccggtgcctacatgactgaaatcgtccgtggtggtatcctagcagttgacaagggacaatttgaagctgcgactgctcttggtatgacccataaccagaccatgcgtaagattgtcctacctcaggtagtccgtaacatcctacctgcaactggtaatgaatttgtcatcaatatcaaagatacatctgtattgaacgttatctctgttgtcgaactttatttctcaggaaataccgtggcaacacaaacctatcaatacttccagacatttacaatcatcgccgtgatttactttgtcctcaccttcaccgtaacacgtatcctacgctttatcgagcgcagaatggacatggatacctacactacaggtgctaaccaaatgcaaacggaggatttgaaataa

SEQ ID NO: 94 - DNA, 396 bp, Streptococcus pneumoniae
atgtcaaagaaactcaatcgtaaaaaacaattacgaaatggcctccgtcgcgcaggtgccttttcaagtacggtgactaaggttgtagatgagacaaaaaaagtcgtgaagcgtgcagaacagtcagcaagcgcagctggtaaggctgtttctaaaaaagttgaacaagcagtagaagctaccaaagagcaagctcaaaaagtagctaattctgtagaagattttgcagcaaatttgggtggacttccacttgatcgtgccaagactttctatgatgaaggaatcaagtctgcttcagatttcaaaaactggactgaaaaagaactccttgccttgaaaggaatcggcccagctaccatcaagaaattgaaagaaaatggcatcaagttcaagtaa

SEQ ID NO: 95 - DNA, 1002 bp, Streptococcus pneumoniae
atgattaaaacatttctctctgccctttcggtcattctcttttctatccctatcataacttattcttttttcccatcttctaatcttaacatttggctatctacccaacctatcttggcacagatttatgccttccccttagctactgcaactatggctgctattttaagtttcttattttttttcctatctttttacaagaaaaataaacaaatacggttttactctggcattttgctcttactatcgctcatattactattattcggaacagataaaaccctttcttctgcatcaaataagactaaaaccttaaaattagtaacttggaacgtcgctaatcaaatagaagcacaacatattgagcgaatttttagccattttgacgccgatatggctatattccctgaactagctaccaatatcagaggtgagcaagaaaaccagagaatcaaactattgtttcatcaagttggactttctatggccaactatgatattttcacttctccacctaccaatagtggaatagctcctgtgactgtgattgtcaagaaaagttatggtttctatacagaagctaaaacttttcatacaacacggttcgggacaattgtattacattcgagaaaacaaaatataccagatatcattgccttgcatactgcgcctcctctgccaggtttaatggaaatctggaagcaagacttaaacatcattcataatcaattggcttcaaaatatccaaaggctattattgcaggtgattttaatgcaactatgcgtcatggagcacttgcaaaaataagctctcatagggacgcattaaatgcactgccaccttttgaaagaggaacttggaatagccaaagtccaaaactttttaatgcaacaatagatcatattttattgcctaaaaaccactactatgttaaagatttagacattgtaagttttcaaaactctgatcatagatgtatttttacagaaatcacattttaa

SEQ ID NO: 96 - DNA, 618 bp, Streptococcus pneumoniae
atggggtggtggcgcgaaaccattgatattgtaaaagaaaatgatccagcggcccgcaccactttggaggttttgctgacttatccaggtgtcaaggccttggcggcccaccgtctctcgcattttctctggaagcacggcttcaaactattagctcgtatgtacagtcagttttggcgcttttggactcagattgagattcatccaggagcccagattgattcaggtgtttttattgaccatggttctggtctggtgattggagagacagcgattgttgaaaaaggcgttcttctctatcacggagtgactctcgggggaacagggaaagactgtggcaaacgccatccgactgtacgaaagggagccctcatatcagcccatgcccaagttatcgggcctgtggaaattggtgaaaatgccaaggtcggtgctgcagcagttgtcgtagcagatgtacctagtgacgtgacggttgtcggtattccggccaagattgtccgtcttcatggtaagaaagatgagcctgtcattcacgaagtcgaagaaaaacgagagtattatgtcaataaactcgagcaggctaaagatgccagtcacagatcgtctggtttgtag

SEQ ID NO: 97 - DNA, 1380 bp, Streptococcus pneumoniae
atgttacacaacgcatttgcctatgttacaaggaagtttttcaaatcgattgtcatcttcctgattattctcctcatggcgagcttgagtttggtcggcttgtcaatcaagggagctactgccaaggcttctcaggagacctttaaaaatatcaccaatagcttctccatgcaaatcaatcgtcgcgtcaaccaaggaacgcctcgtggtgctgggaatatcaagggtgaagacatcaaaaaaatcaccgaaaacaaggccattgagtcttatgtcaaacgtatcaacgctatcggagatttgactggatatgacctgattgaaacgccagaaaccaagaagaatctcactgctgatcgtgccaagcgttttggaagtagcttgatgattacaggtgtcaatgactcctctaaagaagacaagtttgtctctggttcttataaactagtcgaaggagagcacttaaccaacgacgacaaggataaaatcctcttgcacaaggacttggcagccaaacacggctggaaagtaggggacaaggttaaactggactctaatatctacgatgcagataatgaaaaaggagccaaggaaacagttgaagtgacaatcaagggactctttgatggtcataataagtcagcagtaacctactcacaagaactttacgaaaacacagctattacagacattcacactgctgcaaaactttatggatacacagaagacacagccatttatggggacgcaaccttctttgtaacagcagacaagaacttggatgatgttatgaaagagttgaatggcatcagtggtatcaactggaagagctacacactcgtcaagagctcctctaactacccagctcttgagcaatctatctctggtatgtacaagatggccaacctcctcttctggggtagcttgagcttctcagttctcctccttgccctcttgctcagcctttggatcaacgcccgtcgcaaggaagtgggaattctcctctctatcggcctcaagcaggcaagtatcttgggtcaattcatcaccgaatctatcttgattgctatccctgctctagtttctgcttacttcctagctaattacactgcccgtgcaattggaaacactgtccttgccaatgtgacttcaggtgttgccaaacaggctagtaaggcggctcaagcctctaaccttggtggtggtgcagaagtagatggctttagcaagaccttgtcgagcctagacatttccattcagacatcagactttatcatcatttttgtccttgccttggttctagtggttctcgttatggcgcttgcttcaagcaatctccttagaaaacaaccaaaagagctcttgctggatggtgaataa

SEQ ID NO: 98 - DNA, 1329 bp, Streptococcus pneumoniae
atgaaacgaacaggtttatttgcaaagatatttatctataccttctcgatatttagtgttctggttatctgccttcatttagctatttattttctttttccttcgacttatctgagtcatcgtcaggaaaccattggtcaaaaggcaacagccattgcccagtccctagaagggaaagataggcagagtatcgagcaagtgttagacttgtattcccagactagtgatatcaaggggaccgtcaaaggtgagatgaccgaggacaagttagaagtcaaggacagtcttcctctggacacagaccgccagacaacctctctctttattgaggagcgcgaggtgaaaacgcaagacggtggtactatgattctccagtttctagcttccatggatttacaaaaggaagcggagcaaatcagtctccagtttcttccctataccttgctggcctcctttctgatttcccttttggtggcctacatctacgctcggactattgttgcaccgattttggaaatcaagcgggtgacccgtcggatgatggacctggattcccaagtgcgattgcgcgtggattctaaggatgagataggtaatctcaaggaacaaatcaatagcctctaccagcatctcttgactgttattgcggacttgcatgaaaagaatgaagccattctccagctggagaagatgaaggtcgaattcctacgaggagcttctcatgaattgaaaacaccgctggctagtttgaaaatcctaatcgaaaatatgagagagaatatcggtcgttataaggatagagaccagtatctgggagttgccttggggattgtggatgaactcaatcaccatgttctgcagatactttccctctcttctgtgcaggaattgcgagatgatagggaaacaattgacctcctccagatgacgcaaaatctggtcaaagattatgccttgctagccaaggaaagagagctccagatagacaatagtttgacccatcagcaggcttatctaaacccatcagttatgaagttgattctttctaatctcatcagcaatgccattaagcactctgttccaggtggcttagttcgaattggagaaagagaaggagaactttttatcgaaaatagctgtagctcagaggaacaagaaaaactagcccagtctttttctgacaatgccagtcgcaaggtcaaggggtctggtatggggctctttgtggttaagagtctattagaacatgaaaaattagcttatcgtttcgagatggaggagaatagtttaaccttctttatagattttccaaaagtcgtccaagactag

SEQ ID NO: 99 - DNA, 723 bp, Streptococcus pneumoniae
ttgctagaaaggtggagagacatgcgctggctttttcgtttgataggggctttcttttcttttgtgtggcgtttgttttggcgtctggtttggatagttgtgctcttatgtgtgcttgctttcggacttctctggtatctgaacggagattttcaaggagcgctaaagcaagcagaacggtcagtaaaaattggtcaacaaagtattgaccaatgggagaaaacagggcaactgcctaagttaagccagacagatagtcaccagcattctgaaggaaggtgggcacaggcctctgctcgtatttacctggatccgcagatggattcacgctttcaagaggcttatttagaagcaatccagaactggaatcaaactggtgcttttaactttgaactcgtgactgagtctagtaaggcggatattacggctacggagatgaacgacggaggcactcctgtggcaggagaggcggaaagtcaaactaatctcttaacagggcaattcttgtccgtaacggtgcggttgaatcattattatttgtccaatccatactatggctactcctatgaacgccttgtccatacggcagaacatgagttaggtcatgcgattggcttggaccatacagatgagaagtctgtcatgcaaccagcaggttccttttatggtatccaggaagaggatgttgcaaacctccgaaaaatatatgagactagtgagtag

SEQ ID NO: 100 - DNA, 801 bp, Streptococcus pneumoniae
atgaaaaaatttagcctattactagctatcctaccatttttggttgcctgtgagaatcaagctacacccaaagagactagcgctcaaaagacaatcgtccttgctacagctggcgacgtgccaccatttgactacgaagacaagggcaatctgacaggctttgatatcgaagttttaaaggcagtagatgaaaaactcagcgactacgagattcaattccaaagaaccgcctgggagagcatcttcccaggacttgattctggtcactatcaggctgcggccaataacttgagttacacaaaagagcgtgctgaaaaatacctttactcgcttccaatttccaacaatcccctcgtccttgtcagcaacaagaaaaatcctttgacttctcttgaccagatcgctggtaaaacaacacaagaggataccggaacttctaacgctcaattcatcaataactggaatcagaaacacactgataatcccgctacaattaatttttctggtgaggatattggtaaacgaatcctagaccttgctaacggagagtttgatttcctagtttttgacaaggtatccgttcaaaagattatcaaggaccgtggtttagacctctcagtcgttgatttaccttctgcagatagccccagcaattatatcattttctcaagcgaccaaaaagagtttaaagagcaatttgataaagcgctcaaagaactctatcaagacggaacccttgaaaaactcagcaatacctatctaggtggttcttacctcccagatcaatctcagttacaataa

SEQ ID NO: 101 - DNA, 717 bp, Streptococcus pneumoniae
atgaagaaaagatacctagtcttgacagctttgctagccttgagtctagcagcttgttcacaagaaaaaacaaaaaatgaagatggagaaactaagacagaacagacagccaaagctgatggaacagtcggtagtaagtctcaaggagctgcccagaagaaagcagaagtggtcaataaaggtgattactacagcattcaagggaaatacgatgaaatcatcgtagccaacaaacactatccattgtctaaagactataatccaggggaaaatccaacagccaaggcagagttggtcaaactcatcaaagcgatgcaagaggcaggtttccctattagtgatcattacagtggttttagaagttatgaaactcagaccaagctctatcaagattatgtcaaccaagatggaaaggcagcagctgaccgttactctgcccgtcctggctatagcgaacaccagacaggcttggcctttgatgtgattgggactgatggtgatttggtgacagaagaaaaagcagcccaatggctcttggatcatgcagctgattatggctttgttgtccgttatctcaaaggcaaggaaaaggaaacaggctatatggctgaagaatggcacctgcgttatgtaggaaaagaagctaaagaaattgctgcaagtggtctcagtttggaagaatactatggctttgaaggcggagactacgtcgattaa

SEQ ID NO: 102 - DNA, 6702 bp, Streptococcus pneumoniae
atggggaaaggccattggaatcggaaaagagtttatagcattcgtaagtttgctgtgggagcttgctcagtaatgattgggacttgtgcagttttattaggaggaaatatagctggagaatctgtagtttatgcggatgaaacacttattactcatactgctgagaaacctaaagaggaaaaaatgatagtagaagaaaaggctgataaagctttggaaactaaaaatatagttgaaaggacagaacaaagtgaacctagttcaactgaggctattgcatctgagaagaaagaagatgaagccgtaactccaaaagaggaaaaagtgtctgctaaaccggaagaaaaagctccaaggatagaatcacaagcttcaaatcaagaaaaaccgctcaaggaagatgctaaagctgtaacaaatgaagaagtgaatcaaatgattgaagacaggaaagtggattttaatcaaaattggtactttaaactcaatgcaaattctaaggaagccattaaacctgatgcagacgtatctacgtggaaaaaattagatttaccgtatgactggagtatctttaacgatttcgatcatgaatctcctgcacaaaatgaaggtggacagctcaacggtggggaagcttggtatcgcaagactttcaaactagatgaaaaagacctcaagaaaaatgttcgccttacttttgatggcgtctacatggattctcaagtttatgtcaatggtcagttagtggggcattatccaaatggttataaccagttctcatatgatatcaccaaataccttcaaaaagatggtcgtgagaatgtgattgctgtccatgcagtcaacaaacagccaagtagccgttggtattcaggaagtggtatctatcgtgatgtgactttacaagtgacagataaggtgcatgttgagaaaaatgggacaactattttaacaccaaaacttgaagaacaacaacatggcaaggttgaaactcatgtgaccagcaaaatcgtcaatacggacgacaaagaccatgaacttgtagccgaatatcaaatcgttgaacgaggtggtcatgctgtaacaggcttagttcgtacagcgagtcgtaccttaaaagcacatgaatcaacaagcctagatgcgattttagaagttgaaagaccaaaactctggactgttttaaatgacaaacctgccttgtacgaattgattacgcgtgtttaccgtgacggtcaattggttgatgctaagaaggatttgtttggttaccgttactatcactggactccaaatgaaggtttctctttgaatggtgaacgtattaaattccatggagtatccttgcaccacgaccatggggcgcttggagcagaagaaaactataaagcagaatatcgccgtctcaaacaaatgaaggagatgggagttaactccatccgtacaacccacaaccctgctagtgagcaaaccttgcaaatcgcagcagaactaggtttactcgttcaggaagaggcctttgatacgtggtatggtggcaagaaaccttatgactatggacgtttctttgaaaaagatgccactcacccagaagctcgaaaaggtgaaaaatggtctgattttgacctacgtaccatggtcgaaagaggcaaaaacaaccctgctatcttcatgtggtcaattggtaatgaaataggtgaagctaatggtgatgcccactctttagcaactgttaaacgtttggttaaggttatcaaggatgttgataagactcgctatgttaccatgggagcagataaattccgtttcggtaatggtagcggagggcatgagaaaattgctgatgaactcgatgctgttggatttaactattctgaagataattacaaagcccttagagctaagcatccaaaatggttgatttatggatcagaaacatcttcagctacccgtacacgtggaagttactatcgccctgaacgtgaattgaaacatagcaatggacctgagcgtaattatgaacagtcagattatggaaatgatcgtgtgggttgggggaaaacagcaaccgcttcatggacttttgaccgtgacaacgctggctatgctggacagtttatctggacaggtacggactatattggtgaacctacaccatggcacaaccaaaatcaaactcctgttaagagctcttactttggtatcgtagatacagccggcattccaaaacatgacttctatctctaccaaagccaatgggtttctgttaagaagaaaccgatggtacaccttcttcctcactggaactgggaaaacaaagaattagcatccaaagtagctgactcagaaggtaagattccagttcgtgcttattcgaatgcttctagtgtagaattgttcttgaatggaaaatctcttggtcttaagactttcaataaaaaacaaaccagcgatgggcggacttaccaagaaggtgcaaatgctaatgaactttatcttgaatggaaagttgcctatcaaccaggtaccttggaagcaattgctcgtgatgaatctggcaaggaaattgctcgagataagattacgactgctggtaagccagcggcagttcgtcttattaaggaagaccatgcgattgcagcagatggaaaagacttgacttacatctactatgaaattgttgacagccaggggaatgtggttccaactgctaataatctggttcgcttccaattgcatggccaaggtcaactggtcggtgtagataacggagaacaagccagccgtgaacgctataaggcgcaagcagatggttcttggattcgtaaagcatttaatggtaaaggtgttgccattgtcaaatcaactgaacaagcagggaaattcaccctgactgcccactctgatctcttgaaatcgaaccaagtcactgtctttactggtaagaaagaaggacaagagaagactgttttggggacagaagtgccaaaagtacagaccattattggagaggcacctgaaatgcctaccactgttccgtttgtatacagtgatggtagccgtgcagaacgtcctgtaacctggtcttcagtagatgtgagcaagcctggtattgtaacggtgaaaggtatggctgacggacgagaagtagaagctcgtgtagaagtgattgctcttaaatcagagctaccagttgtgaaacgtattgctccaaatactgacttgaattctgtagacaaatctgtttcctatgttttgattgatggaagtgttgaagagtatgaagtggacaagtgggagattgccgaagaagataaagctaagttagcaattccaggttctcgtattcaagcgaccggttatttagaaggtcaaccaattcatgcaacccttgtggtagaagaaggcaatcctgcggcacctgcagtaccaactgtaacggttggtggtgaggcagtaacaggtcttactagtcaaaaaccaatgcaataccgcactcttgcttatggagctaagttgccagaagtcacagcaagtgctaaaaatgcagctgttacagttcttcaagcaagcgcagcaaacggcatgcgtgcgagcatctttattcagcctaaagatggtggccctcttcaaacctatgcaattcaattccttgaagaagcgccaaaaattgctcacttgagcttgcaagtggaaaaagctgacagtctcaaagaagaccaaactgtcaaattgtcggttcgagctcactatcaagatggaacgcaagctgtattaccagctgataaagtaaccttctctacaagtggtgaaggggaagtcgcaattcgtaaaggaatgcttgagttgcataagccaggagcagtcactctgaacgctgaatatgagggagctaaagaccaagttgaactcactatccaagccaatactgagaagaagattgcgcaatccatccgtcctgtaaatgtagtgacagatttgcatcaggaaccaagtcttccagcaacagtaacagttgagtatgacaaaggtttccctaaaactcataaagtcacttggcaagctattccgaaagaaaaactagactcctatcaaacatttgaagtactaggtaaagttgaaggaattgaccttgaagcgcgtgcaaaagtctctgtagaaggtatcgtttcagttgaagaagtcagtgtgacaactccaatcgcagaagcaccacaattaccagaaagtgttcggacatatgattcaaatggtcacgtttcatcagctaaggttgcatgggatgcgattcgtccagagcaatacgctaaggaaggtgtctttacagttaatggtcgcttagaaggtacgcaattaacaactaaacttcatgttcgcgtatctgctcaaactgagcaaggtgcaaacatttctgaccaatggaccggttcagaattgccacttgcctttgcttcagactcaaatccaagcgacccagtttcaaatgttaatgacaagctcatttcctacaataaccaaccagccaatcgttggacaaactggaatcgtactaatccagaagcttcagtcggtgttctgtttggagattcaggtatcttgagcaaacgctccgttgataatctaagtgtcggattccatgaagaccatggagttggtgtaccgaagtcttatgtgattgagtattatgttggtaagactgtcccaacagctcctaaaaaccctagttttgttggtaatgaggaccatgtctttaatgattctgccaactggaaaccagttactaatctaaaagcccctgctcaactcaaggctggagaaatgaaccactttagctttgataaagttgaaacctatgctgttcgtattcgcatggttaaagcagataacaagcgtggaacgtctatcacagaggtacaaatctttgcgaaacaagttgcggcagccaagcaaggacaaacaagaatccaagttgacggcaaagacttagcaaacttcaaccctgatttgacagactactaccttgagtctgtagatggaaaagttccggcagtcacagcaagtgttagcaacaatggtctcgctaccgtcgttccaagcgttcgtgaaggtgagccagttcgtgtcatcgcgaaagctgaaaatggcgacatcttaggagaataccgtctgcacttcactaaggataagagcttactttctcataaaccagttgctgcggttaaacaagctcgcttgctacaagtaggtcaagcacttgaattgccgactaaggttccagtttacttcacaggtaaagacggctacgaaacaaaagacctgacagttgaatgggaagaagttccagcggaaaatctgacaaaagcaggtcaatttactgttcgaggccgtgtccttggtagtaaccttgttgctgagatcactgtacgagtgacagacaaacttggtgagactctttcagataaccctaactatgatgaaaacagtaaccaggcctttgcttcagcaaccaatgatattgacaaaaactctcatgaccgcgttgactatctcaatgacggagatcattcagaaaatcgtcgttggacaaactggtcaccaacaccatcttctaatccagaagtatcagcgggtgtgattttccgtgaaaatggtaagattgtagaacggactgttacacaaggaaaagttcagttctttgcagatagtggtacggatgcaccatctaaactcgttttagaacgctatgtcggtccagagtttgaagtgccaacctactattcaaactaccaagcctacgacgcagaccatccattcaacaatccagaaaattgggaagctgttccttatcgtgcggataaagacattgcagctggtgatgaaatcaacgtaacatttaaagctatcaaagccaaagctatgagatggcgtatggagcgtaaagcagataagagcggtgttgcgatgattgagatgaccttccttgcaccaagtgaattgcctcaagaaagcactcaatcaaagattcttgtagatggaaaagaacttgctgatttcgctgaaaatcgtcaagactatcaaattacctataaaggtcaacggccaaaagtctcagttgaagaaaacaatcaagtagcttcaactgtggtagatagtggagaagatagctttccagtacttgttcgcctcgtttcagaaagtggaaaacaagtcaaggaataccgtatccacttgactaaggaaaaaccagtttctgagaagacagttgctgctgtacaagaagatcttccaaaaatcgaatttgttgaaaaagatttggcatacaagacagttgagaaaaaagattcaacactgtatctaggtgaaactcgtgtagaacaagaaggaaaagttggaaaagaacgtatctttacagcgattaatcctgatggaagtaaggaagaaaaactccgtgaagtggtagaagttccgacagaccgcatcgtcttggttggaaccaaaccagtagctcaagaagctaaaaaaccacaagtgtcagaaaaagcagatacaaaaccaattgattcaagtgaagctagtcaaactaataaagcccagttaccaagtacaggtagtgcggcaagccaagcagcagtagcagcaggtttaactcttctaggtttgagtgcaggattagtagttactaaaggtaaaaaagaagactag

SEQ ID NO: 103 - DNA, 567 bp, Streptococcus pneumoniae
atgaaaaaatggcaaacatgtgttcttggagcaggttcgctcctttgtttgacggcttgttcaggcaagtccgtgactagtgaacaccaaacgaaagatgaaatgaagacggagcagacagctagtaaaacaagcgcagctaaagggaaagaggtggctgattttgaattgatgggagtagatggcaagacctaccgtttatctgattacaagggcaagaaagtctatctcaaattctgggcttcttggtgttccatctgtctggctagtcttccagatacggatgagattgctaaagaagctggtgatgactatgtggtcttgacagtagtgtcaccaggacataagggagagcaatctgaagcggactttaagaattggtataagggattggattataaaaatctcccagtcctagttgacccatcaggcaaacttttggaaacttatggtgtccgttcttacccaacccaagcctttatagacaaagaaggcaagctggtcaaaacacatccaggattcatggaaaaagatgcaattttgcaaactttgaaggaattagcctag

SEQ ID NO: 104 - DNA, 1692 bp, Streptococcus pneumoniae
atgaagcgttcttctcttttagttagaatggttatttccatctttctggtctttctcattctcctagctctggttggaactttctactatcaatcaagttcttcagccattgaggccaccattgagggcaacagccaaacgaccatcagccagactagccactttattcagtcttatatcaaaaaactagaaaccacctcgactggtttgacccagcagacggatgttctggcctatgctgagaatcccagtcaagacaaggtcgagggaatccgagatttgtttttgaccatcttgaagtcagataaggacttgaaaactgttgtgctggtgaccaaatctggtcaggtcatttctacagatgacagtgtgcagatgaaaacttcctctgatatgatggctgaggattggtaccaaaaggccattcatcagggagctatgcctgttttgactccagctcgtaaatcagatagtcagtgggtcatttctgtcactcaagaacttgttgatgcaaagggagccaatcttggtgtgcttcgtttggatatttcttatgaaactctggaagcctatctcaatcaactccagttggggcagcagggctttgccttcattatcaatgaaaaccatgaatttgtctaccatcctcaacacacagtttatagttcgtctagcaaaatggaggctatgaaaccctacatcgatacaggtcagggttatactcctggtcacaaatcctacgtcagtcaagagaagattgcaggaactgattggacggtgcttggcgtgtcatcattggaaaagttagaccaggttcggagtcagctcttgtggaccttgcttggggccagtgtcacatctcttcttgtctgtctctgcttagtgtggttcagtcttaaacgctggattgctcctttgaaggatttgagagaaaccatgttggaaattgcttctggtgctcaaaatcttcgtgccaaggaagttggtgcctatgaactgagagaagtaactcgccaatttaatgctatgttggatcagattgatcagttgatggtagctattcgtagccaggaagaaacgacccgtcagtaccaacttcaagccctttcgagccagattaatccacatttcctctataacactttggacaccatcatctggatggctgaatttcatgatagtcagcgagtggtgcaggtgaccaagtccttggcaacctatttccgcttggcgctcaatcaaggcaaggacttgatttgtctctctgacgaaatcaatcatgtccgccagtatctctttatccagaaacaacgctatggagataagctggaatacgaaattaatgaaaatgttgcctttgataatttagtcttacccaagctggtcctacaaccccttgtagaaaatgctctttaccatggcattaaggaaaaggaaggtcagggccatattaaactttctgtccagaaacaggattcgggattggtcatccgtattgaggatgatggcgttggcttccaagatgctggtgatagtagtcaaagtcaactcaaacgtgggggagttggtcttcaaaatgtcgatcaacggctcaaacttcattttggagccaattaccatatgaagattgattctagaccccaaaaagggacgaaagttgaaatatatataaatagaatagaaactagctaa

SEQ ID NO: 105 - DNA, 5646 bp, Streptococcus pneumoniae
atggctccttctgtagtggacgcagccacctatcactatgtaaataaagagattatttcacaagaagctaaagatttaattcagacaggaaagcctgacaggaatgaagttgtatatggtttggtgtatcaaaaagatcagttgcctcaaacagggacagaagcatctgttttgacagcttttggtttgctgactgttgggagcttgcttttaatctacaagagaaagaaaattgctagcgtctttctagttggagctatgggattggtagttcttcctagtgcaggggctgtagacccagttgcgaccctagcgctggctagtcgagagggtgttgttgaaatggagggctatcgctatgttggttatctatcaggtgacatcctcaaaacgcttggcttggacactgttttagaagaaacctcagcaaaacctggagaggtgactgtggtcgaagttgagactcctcaatcaataacaaatcaggagcaagctaggacagaaaaccaagtagtagagacagaggaagctccaaaagaagaagcacctaaaacagaagaaagtccaaaggaagaaccaaaatcggaggtaaaacctactgacgacacccttcctaaagtagaagaggggaaagaagattcagcagaaccagctccagttgaagaagtaggtggagaagttgagtcaaaaccagaggaaaaagtagcagttaagccagaaagtcaaccatcagacaaaccagctgaggaatcaaaagttgaacaagcaggtgaaccagtcgcgccaagagaagacgaaaaggcaccagtcgagccagaaaagcaaccagaagctcctgaagaagagaaggctgtagaggaaacaccgaaacaagaagagtcaactccagataccaaggctgaagaaactgtagaaccaaaagaggagactgttaatcaatctattgaacaaccaaaagttgaaacgcctgctgtagaaaaacaaacagaaccaacagaggaaccaaaagttgaacaagcaggtgaaccagtcgcgccaagagaagacgaacaggcaccaacggcaccagttgagccagaaaagcaaccagaagttcctgaagaagagaaggctgtagaggaaacaccgaaaccagaagataaaataaagggtattggtactaaagaaccagttgataaaagtgagttaaataatcaaattgataaagctagttcagtttctcctactgattattctacagcaagttacaatgctcttggacctgttttagaaactgcaaaaggtgtctatgcttcagagcctgtaaaacagcctgaggtaaatagcgagacaaataaacttaaaacggctattgacgctctaaacgttgataaaactgaattaaacaatacgattgcagatgcaaaaacaaaggtaaaagaacattacagtgatagaagttggcaaaacctccaaactgaagttacaaaggctgaaaaagttgcagctaatacagatgctaaacaaagtgaagttaacgaagctgttgaaaaattaactgcaactattgaaaaattggttgaattatctgaaaagccaatattaacattgactagtaccgataagaaaatattggaacgtgaagctgttgctaagtatactctagaaaatcaaaacaaaacaaaaatcaaatcaatcacagctgaattgaaaaaaggagaagaagttattaatactgtagtccttacagatgacaaggtaacaacagaaactataagcgctgcatttaagaacctagagtactacaaagaatacaccctatctacaactatgatttacgacagaggtaacggtgaagaaactgaaactctagaaaatcaaaatattcaattagatcttaaaaaagttgagcttaaaaatattaaacgtacagatttaatcaaatacgaaaatggaaaagaaactaatgaatcactgataacaactattcctgatgataagagcaattattatttaaaaataacttcaaataatcagaaaactacattactagctgttaaaaatatagaagaaactacggttaacggaacacctgtatataaagttacagcaatcgcagacaatttagtctctagaactgctgataataaatttgaagaagaatacgttcactatattgaaaaacctaaagtccacgaagataatgtatattataatttcaaagaattagtggaagctattcaaaacgatccttcaaaagaatatcgtctgggacaatcaatgagcgctagaaatgttgttcctaatggaaaatcatatatcactaaagaattcacaggaaaacttttaagttctgaaggaaaacaatttgctattactgaattggaacatccattatttaatgtgataacaaacgcaacgataaataatgtgaattttgaaaatgtagagatagaacgttctggtcaagataatattgcatcattagccaatactatgaaaggttcttcagttattacaaatgtcaaaattacaggcacactttcaggtcgtaataatgttgctggatttgtaaataatatgaatgatggaactcgtattgaaaatgttgctttctttggcaaactacactctacaagtggaaatggctctcatacagggggaattgcaggtacaaactatagaggaattgttagaaaagcatatgttgatgctactattacaggaaacaaaacacgcgccagcttgttagttcctaaagtagattatggattaactctagaccatcttattggtacaaaagctctcctaactgagtcggttgtaaaaggtaaaatagatgtttcaaatccagtagaagttggagcaatagcaagtaagacttggcctgtaggtacggtaagtaattctgtcagctatgctaagattatccgtggagaggagttattcggctctaacgacgttgatgattctgattatgctagtgctcatataaaagatttatatgcggtagagggatattcgtcaggtaatagatcatttaggaaatctaaaacatttactaaattaactaaagaacaagctgatgctaaagttactactttcaatattactgctgataaattagaaagtgatctatctcctcttgcaaaacttaatgaagaaaaagcctattctagtattcaagattataacgctgaatataaccaagcctataaaaatcttgaaaaattaataccattctacaataaagattatattgtatatcaaggtaataaattaaataaagaacaccatctaaatactaaagaagttctttctgttaccgcgatgaacaacaatgagtttatcacaaacctagatgaagctaataaaattattgttcactatgcggacggtacaaaagattactttaacttgtcttctagcagtgaaggtttaagtaatgtaaaagaatatactataactgacttaggaattaaatatacacctaatatcgttcaaaaagataacactactcttgttaatgatataaaatctattttagaatcagtagagcttcagtctcaaacgatgtatcagcatctaaatcgattaggtgactatagagttaatgcaatcaaagatttatatttagaagaaagcttcacagatgttaaagaaaacttaacaaacctaatcacaaaattagttcaaaacgaagaacatcaactaaatgattctccagctgctcgtcaaatgattcgtgataaagtcgagaaaaacaaagcagctttattactaggtttaacttacctaaatcgttactatggagttaaatttggtgatgttaatattaaagaattaatgctattcaaaccagatttctatggtgaaaaagttagcgtattagacagattaattgaaatcggttctaaagagaacaacattaaaggttcacgtacattcgacgcattcggtcaagtattggctaaatatactaaatcaggtaatttagatgcatttttaaattataatagacaattgttcacaaatatagacaatatgaacgattggtttattgatgctacagaagaccatgtctacatcgcagaacgcgcttctgaggtcgaagaaattaaaaattctaaacatcgtgcattcgataatttaaaacgaagtcaccttagaaatactatactcccactactgaatattgataaagcacatctttatttaatttcaaattataatgcaattgcctttggtagtgcagagcgattaggtaaaaaatcattagaagatattaaagatatcgttaacaaagctgcagatggttatagaaactattatgatttctggtatcgtctagcgtctgataacgttaaacaacgactactaagagatgctgttattcctatttgggaaggttataacgctcctggtggatgggttgaaaaatatggccgctataataccgacaaagtatatactcctcttagagaattctttggtcctatggataagtattataattataatggaacaggagcttatgctgctatatatcctaactctgatgatattagaactgatgtaaaatatgttcatttagaaatggttggtgaatacggtatttcagtttacacacatgaaacaacacacgtcaacgaccgtgcgatttacttaggtggctttggacaccgtgaaggtactgatgctgaagcatatgctcagggtatgctacaaactcctgttactggtagtggatttgatgagtttggttctttaggtattaatatggtatttaaacgcaaaaatgatgggaatcagtggtatattacagatccaaaaactctaaaaacacgagaagatattaatagatatatgaagggttataatgacactttaactcttcttgatgaaattgaggctgaatctgtgatttctcaacaaaataaagatttaaatagtgcatggttcaaaaaaatagatagagaataccgtgataacaataaattaaatcaatgggataaaattcgaaatctaagtcaagaagagaaaaatgaattaaatattcaatctgttaatgatttagttgatcaacaattaatgactaatcgcaatccaggtaatggtatctataaacccgaagcaattagctataacgatcaatcaccttatgtaggtgttagaatgatgaccggtatctacggaggtaatactagtaaaggtgctcctggagctgtttcattcaaacataatgcttttagattatggggttactacggatacgaaaatgggttcttaggttatgcttcaaataaatataaacaacaatctaaaacagatggtgagtctgttctaagtgatgaatatattatcaagaaaatatctaacaatacatttaatactattgaagaatttaaaaaagcttacttcaaagaagttaaagataaagcaacgaaaggattaacaacattcgaagtaaatggttcttccgtttcatcatacgatgatttactgacattgtttaaagaagctgttaaaaaagatgccgaaactcttaaacaagaagcaaacggtaataaaacagtatctatgaataatacagttaaattaaaagaagctgtttataagaaacttcttcaacaaacaaatagctttaaaacttcaatctttaaataa

SEQ ID NO: 106 - DNA, 381 bp, Streptococcus pneumoniae
atggttacttggattttgtgggcacttatactagcaatgttggcgtggatgggctttaactatcttcgtattcgccgtgcggctaaaattgtggacaatgaggagtttgaagccttgattcgtacgggtcaattgattgatttgcgcgacccagcagaattccacagaaaacatatccttggtgcacgcaatattccttcaagtcagttgaaaactagtcttgcagcccttcgtaaagataaacctgtccttctctacgaaaaccaacgtgcgcaacgagttacaaatgcagctctttacttgaaaaaacaaggtttttctgagatttatatcctttcttatggcttggattcttggaaagggaaagtgaagactagctaa

SEQ ID NO: 107 - DNA, 804 bp, Streptococcus pneumoniae
atgcaggaatttacaaatccctttcctataggctctagttccctcattcactgcattaccaatgagatttcttgtgagatgctggcaaatgggattttggctctgggatgcaaacctgtcatggcagatgattcccgtgaagttcttgattttactaagcaaagtcaggctctcttcatcaatttggggcatttgtcagctgagaaggaaaaagcaatccgcatggcagcttcgtatgcaaaccaatcttctctcccgatggtagtagatgcggttggcgtaacgacttcatccattcgtaagagcttagttaaagaccttttagactatagacctacggtccttaaaggaaacatgtcagaaattcgaagtcttgttggattaaagcaccacggcgttggggtcgatgcgagtgctaaagatcaagaaacggaggatttgcttcaagtcttgaaagactggtgtcagacctatcctggtatgtctttcttagtcacaggtcccaaggacctcgtcgtttcgaaaaatcaggtcgctgtactgggaaatggctgtactgaattagactggataacagggacaggagacttggttggagccttaacagctgtttttctcagccaaggaaagactggttttgaagcttcttgcttagcagtctcttatctcaatatcgctgctgagaaaatagttgttcaaggaatgggattggaagaatttcgttaccaagtactcaatcagctttcgctcctaagaagagatgaaaattggctagataccatcaaaggagaggtttatgaatag

SEQ ID NO: 108 - DNA, 846 bp, Streptococcus pneumoniae
atgacttggaagattattgctgactctggttgtgattatcgtcaactgccaacaccagctattaacacaacctttgtaagtgtccccttaaccattcaagtagctgatcaggtctttgttgatgacgccagtctcgatattgaccaaatgatggaaaccatgtatgcaactgcagaagcttcaaaatcggcttgtccaagcccagatgactatttgcgagcatttgaaggtgccaaaaacattttcctagtaaccatcacaggtaccctttctggcagtcacaatagtgctcaactagcaaagaatatttatctggaagaccatcctgacactaagattcatgtgattgatagtttatctgctggtggtgaagttgacctactcgtagaaaaattgaatgacttgattgaccagggcttgtcttttgaagaagtggttgaagctatcaccgcctatcaagaaaaaactaagttgctctttgtcctagccaaagtcgataacttggtgaagaacggccgtttgagcaagcttatcggtacggtcgttggccttctcaacattcgtatggtcggaaaagctagtgaaactgggactctcgaattgctacaaaaagcaaggggatcaaagaaatcagttcaagctgcctatgatgagttagtaaaagctggatatgctggtggccgtattgtcatggcccaacgcaataacgaaaaatgttgtcaacagctctcagagcgaatccgtgaaaccttcccacaagcggatattaaaattctaccaacctctggtctctgcagtttctatgcagaagagggcggtttgctgatgggctatgaaattgattaa

SEQ ID NO: 109 - DNA, 927 bp, Streptococcus pneumoniae
atgattagtagattttttcgccatttatttgaagccttaaaaagtttgaaacgaaatggttggatgacagtagctgctgtcagttcagtcatgattactttgaccttggtggcaatatttgcatctgttattttcaatacagcgaaactagctacagatattgaaaataatgtccgtgtagtagtttatatccgaaaggatgtggaagataatagtcagacaattgaaaaagaaggtcaaactgttacaaataatgactaccacaaggtatatgattctttgaagaacatgtctacggttaaaagtgttaccttttcaagtaaagaagaacaatatgaaaaattaaccgagataatgggagataactggaaaatctttgaaggagatgccaatcctctctatgatgcctatattgtagaggcaaacactccaaatgatgtaaaaactatagccgaagatgctaaaaaaattgaaggtgtctctgaggttcaagatggcggtgccaatacagaaagactcttcaagttagcttcatttatccgtgtttggggactagggattgctgctttgttaatttttatcgcagttttcttgatttcaaataccattcgtattaccattatttcccgcagtcgcgaaattcaaatcatgcgcttggtcggagctaaaaacagttatatccgtggaccgttcttgttagaaggagcctttatcggtttattgggagctatcgcaccatctgttttggtctttattgtttatcaaattgtttaccaatctgtcaacaaatcgttggtagggcaaaatctatccatgattagtccagatttatttagtccgttgatgattgccctactatttgtgattggggttttcattggttcattgggatcaggaatatccatgcgccgattcttgaagatttag

SEQ ID NO: 110 - DNA, 1200 bp, Streptococcus pneumoniae
atgaagaaaaagaatggtaaagctaaaaagtggcaactgtatgcagcaatcggtgctgcgagtgtagttgtattgggtgctggggggattttactctttagacaaccttctcagactgctctaaaagatgagcctactcatcttgttgttgccaaggaaggaagcgtggcctcctctgttttattgtcagggacagtaacagcaaaaaatgaacaatatgtttattttgatgctagtaagggtgatttagatgaaatccttgtttctgtgggcgataaggtcagcgaagggcaggctttagtcaagtacagtagttcagaagcgcaggcggcctatgattcagctagtcgagcagtagctagggcagatcgtcatatcaatgaactcaatcaagcacgaaatgaagccgcttcagctccggctccacagttaccagcgccagtaggaggagaagatgcaacggtgcaaagcccaactccagtggctggaaattctgttgcttctattgacgctcaattgggtgatgcccgtgatgcgcgtgcagatgctgcggcgcaattaagcaaggctcaaagtcaattggatgcaacaactgttctcagtaccctagagggaactgtggtcgaagtcaatagcaatgtttctaaatctccaacaggggcgagtcaagttatggttcatattgtcagcaatgaaaatttacaagtcaagggagaattgtctgagtacaatctagccaacctttctgtaggtcaagaagtaagctttacttctaaagtgtatcctgataaaaaatggactgggaaattaagctatatttctgactatcctaaaaacaatggtgaagcagctagtccagcagccgggaataatacaggttctaaatacccttatactattgatgtgacaggcgaggttggtgatttgaaacaaggtttttctgtcaacattgaggttaaaagcaaaactaaggctattcttgttcctgttagcagtctagtaatggatgatagtaaaaattatgtctggattgtggatgaacaacaaaaggctaaaaaagttgaggtttcattgggaaatgctgacgcagaaaatcaagaaatcacttctggtttaacgaacggtgctaaggtcatcagtaatccaacatcttccttggaagaaggaaaagaggtgaaggctgatgaagcaactaattag

SEQ ID NO: 111 - DNA, 1260 bp, Streptococcus pneumoniae
atgcagaatctgaaatttgccttttcatctatcatggctcacaagatgcgttctttgcttactatgattgggattattatcggtgtttcatcagttgttgtgattatggctttgggtgattccctatctcgtcaagtcaataaagatatgactaaatctcagaaaaatattagcgtctttttctctcctaaaaaaagtaaagacgggtcttttactcagaaacaatcagcttttacggtttctggaaaggaagaggaagttcctgttgaaccgccaaaaccgcaagaatcctgggtccaagaggcagctaaactgaagggagtggatagttactatgtaaccaattcaacgaatgccatcttgacctatcaagataaaaaggttgagaatgctaatttgacaggtggaaacagaacttacatggacgctgttaagaatgaaattattgcaggtcgtagtctgagagagcaagatttcaaagagtttgcaagtgtcattttgctagatgaggaattgtccattagtttatttgaatctcctcaagaggctattaacaaggttgtagaagtcaatggatttagttaccgggtcattggggtttatactagtccggaggctaaaagatcaaaaatatatgggtttggtggcttgcctattactaccaatatctcccttgctgcgaattttaatgtagatgaaatagctaatattgtctttcgagtgaatgataccagtttaaccccaactctgggtccagaactggcacgaaaaatgacagagcttgcaggcttacaacagggagaataccaggtggcagatgagtccgttgtatttgcagaaattcaacaatcgtttagttttatgacgacgattattagttccatcgcagggatttctctctttgttggaggaactggtgtcatgaacatcatgctggtttcggtgacagagcgcactcgtgagattggtcttcgtaaggctttgggtgcaacacgtgccaatattttaattcagtttttgattgaatccatgattttgaccttgttaggtggcttaattggcttgacaattgcaagtggtttaactgccttagcaggtttgttactgcaaggtttaatagaaggtatagaagttggagtatcaatcccagtcgccctatttagtcttgcagtttcggctagtgttggtatgatttttggagtcttgccagccaacaaggcatcgaaacttgatccaattgaagcccttcgttatgaatga

SEQ ID NO: 112 - DNA, 1242 bp, Streptococcus pneumoniae
atgaaaaaaatatttttaactttgttaactgtctctcttttagggggtgcttctactgctgttgctcaagattttaccattgccgctaaacatgcgattgctgttgaggcaaatactggtaaaattctctatgagaaggatgcaacgcaacctgtcgaaattgcttccataacaaaattgattactgtttatctggtctatgaagctttggaaaacggaagtattaccctctccactcctgtagatatttctgattatccttatcaattgacgacaaattctgaagccagtaatattcctatggaggcccgtaattatactgtcgaagagttgcttgaagcaactctggtatctagtgccaacagcgccgctattgccctagctgagaaaattgctggctcagaaaaagatttcgtcgatatgatgcgggcaaaactcttggaatggggaattcaggatgccactgttgtcaatacgacaggtcttaacaatgaaactctaggggataacatttacccaggttctaaaaaagatgaggaaaataagcttagtgcttatgatgtcgctatcgttgctcgcaacctcatcaaaaaatacccacaagtcttagaaatcaccaaaaaaccttcttctacttttgctgggatgacaatcacttcaaccaactacatgttagaaggtatgcctgcttaccgtggtggttttgatgggctaaaaacaggaacaacagataaggctggagagtcttttgttggtactactgtcgaaaaaggcatgagagtcatcacagttgttttaaatgcagatcatcaagacaataatccttacgctcgatttacagctacatcttccctaatggattatatttcttctacatttacacttcgcaaaatcgttcaacaaggcgatgcctatcaagatagcaaagcccctgtacaagatggaaaagaagatacagtaactgcagtggctccagaggatatctatctaatcgaacgtgttgggaatcaatcttcccaatctgttcaattcacacctgattccaaagcaatcccagcaccacttgaagctggaacagtggttggccatttgacttatgaagacaaggacttgattggtcaaggttacatcaccacagagcgccctagtttcgaaatggtagcagacaagaaaattgaaaaagccttcttcttaaaagtttggtggaatcagtttgtccgctttgttaacgagaaattataa

SEQ ID NO: 113 - DNA, 2304 bp, Streptococcus pneumoniae
atggcaaacaagaatacaagtacaacaagacggagaccgtctaaagcagaactggaaagaaaagaagcgattcaacgaatgttgatttcgttaggaattgcgattttattgattttcgcagccttcaaattaggggctgcaggtataaccctttataatttaattcgcttgctagtgggtagcctagcttatctggcgatattcggcctattaatctatctcttctttttcaagtggatacgaaaacaggaaggactcttatctggctttttcaccatatttgctggcttactcttgatttttgaggcctacttggtttggaaatatggtttggacaagtccgttctaaaagggaccatggctcaggttgtgacagatctgactggttttcgaacgactagctttgctggagggggcttgatcggggtcgctctttatattccaacagcctttctcttttcaaatatcggaacttactttattggttctatcttgattttagtgggttctctcctagtcagcccttggtctgtttacgatattgctgaatttttcagtagaggctttgccaaatggtgggaagggcacgagcgtcgaaaagaggaacgctttgtcaaacaagaagaaaaagctcgccaaaaggctgagaaagaggctagattagaacaagaagagactgaaaaagccttactcgatttgcctcctgttgatatggaaacgggtgaaattctgacagaggaagctgttcaaaatcttccacctattccagaagaaaagtgggtggaaccagaaatcatcctgcctcaagctgaacttaaattccctgaacaggaagatgactcagatgacgaagatgttcaggtcgatttttcagccaaagaagcccttgaatacaaacttccaagcttacaactctttgcaccagataaaccaaaagatcagtctaaagagaagaaaattgtcagagaaaatatcaaaatcttagaagcaacctttgctagctttggtattaaggtaacagttgaacgggccgaaattgggccatcagtgaccaagtatgaagtcaagccggctgttggtgtaagggtcaaccgcatttccaatctatcagatgacctcgctctagccttggctgccaaagatgtccggattgaagcaccaatccctgggaaatccctaatcggaattgaagtgcccaactccgatattgccactgtatctttccgagaactatgggaacaatcgcaaacgaaagcagaaaatttcttggaaattcctttagggaaggctgttaatggaaccgcaagagcttttgacctttctaaaatgccccacttgctagttgcaggttcaacgggttcagggaagtcagtagcagttaacggcattattgctagcattctcatgaaggcgagaccagatcaagttaaatttatgatggtcgatcccaagatggttgagttatctgtttacaatgatattccccacctcttgattccagtcgtgaccaatccacgcaaagccagcaaggctctgcaaaaggttgtggatgaaatggaaaaccgttatgaactctttgccaaggtgggagttcggaatattgcaggttttaatgccaaggtagaagagttcaattcccagtctgagtacaagcaaattccgctaccattcattgtcgtgattgtggatgagttggctgacctcatgatggtggccagcaaggaagtggaagatgctatcatccgtcttgggcagaaggcgcgtgctgcaggtatccacatgattcttgcaactcagcgtccatctgttgatgtcatctctggtttgattaaggccaatgttccatctcgtgtagcatttgcggtttcatcaggaacagactcccgtacgattttggatgaaaatggagcagaaaaacttcttggtcgaggagacatgctctttaaaccgattgatgaaaatcatccagttcgtctccaaggctcctttatctcggatgacgatgttgagcgcattgtgaacttcatcaagactcaggcagatgcagactacgatgagagttttgatccaggtgaggtttctgaaaatgaaggagaattttcggatggagatgctggtggtgatccgctttttgaagaagctaagtctttggttatcgaaacacagaaagccagtgcgtctatgattcagcgtcgtttatcagttggatttaaccgtgcgacccgtctcatggaagaactggagatagcaggtgtcatcggtccagctgaaggtaccaaacctcgaaaagtgttacaacaataa

SEQ ID NO: 114 - DNA, 873 bp, Streptococcus pneumoniae
atgaagaaatcaagaaaattagccacattaggaatctgttcagccttgtttttaggcttggctgcttgtcaacaacaacatgctacttctgaggggacgaatcaaaggcaaagcagttcagcgaaagttccatggaaagcttcatacaccaacctaaacaaccaggtaagtacagaagaggtcaaatctctcttatcagctcacttggatccaaatagtgttgatgcattttttaatctcgttaatgactataataccattgtcggctcaactggcttatcaggagatttcacttcctttactcacaccgaatacgatgttgagaaaatcagtcatctctggaatcaaaagaagggcgattttgttgggaccaactgccgtatcaatagttattgtcttttgaaaaattcagtcaccattccaaagcttgaaaagaatgaccagttgcttttcctagataatgatgcgattgataaaggaaaggtctttgattcacaagataaggaagagtttgatattctattttcgagagttccaactgagtcaactacagatgtcaaggttcacgctgaaaagatggaagcattcttctcacaatttcaattcaatgaaaaagctcgaatgctgtctgtagtcttgcacgacaatttggatggcgagtatctgtttgtaggccacgttggggtcttagtacctgctgatgacggtttcttatttgtagagaaattgactttcgaagagccctaccaagcgattaaatttgctagtaaggaagattgctacaagtatttgggcaccaagtatgcggattatacaggcgagggactggctaagccttttatcatggataatgataagtgggttaaactttaa

SEQ ID NO: 115 - DNA, 918 bp, Streptococcus pneumoniae
atgaagaaacaaaatttatttttagtcctgttaagtgtctttcttttgtgcttgggggcttgtggtcaaaaggaaagtcagacaggaaaggggatgaaaattgtgaccagtttttatcctatctacgctatggttaaggaagtatctggtgacttgaatgatgttcggatgattcagtcaagtagtggtattcactcctttgaaccttcggcaaatgatatcgcagccatctatgatgcagatgtctttgtttaccattctcatacactcgaatcttgggcaggaagtctggatccaaatctaaaaaaatccaaagtgaaggtcttagaggcttctgagggaatgaccttggaacgtgtccctggactagaggatgtggaagcaggggatggagttgatgaaaaaacgctctatgaccctcacacatggctagatcctgaaaaagctggagaagaagcccaaattatcgctgataaactttcagaggtggatagtgagcataaagagacttatcaaaaaaatgcgcaagcctttatcaaaaaagctcaggaattgactaagaaattccaaccaaaatttgaaaaagcgactcagaaaacatttgtaacacaacatacagccttttcttatctagcgaagagatttgggcttaatcaacttggtattgcaggtatctctcctgaacaagaaccaagtccacgacaactaacagaaattcaggaatttgttaagacctataaggttaaaacgatttttacagaaagtaacgcttcttcaaaagtagctgaaactcttgtcaaatcaacaggtgtgggtcttaaaactctgaatcctttagagtcagacccacaaaatgacaagacctatttagaaaatcttgaagaaaatatgagtattctagcagaagaattaaagtga

SEQ ID NO: 116 - DNA, 615 bp, Streptococcus pneumoniae
atgtttaaacgaattcgaagagtgcttgtactagcagtcttcctttttgctggctataaagcttaccgcgttcatcaagatgtcaaacaagtcatgacctatcaacccatggtgcgagaaatattgagtgaacaagacaccccagcaaacgaagagcttgtgcttgctatgatttatactgaaacaaaaggaaaagaaggcgatgttatgcagtctagtgagtctgcaagtggttccaccaacaccatcaatgataatgcctctagcattcggcaaggcattcaaactctgacaggcaatctctatctggcgcagaagaagggggtagatatctggacagctgttcaagcctataattttggacctgcctatatcgattttatcgcccaaaatggcaaggaaaataccctggctctagccaaacagtactctcgtgagactgttgcccccttgcttggtaataggactggaaagacttatagttatattcaccccatttccatttttcacggtgctgaactctatgtaaatggaggaaactattattattctagacaggtacgacttaacctttacatcatcaaatgtttcactctcttttcaacatctggctag

SEQ ID NO: 117 - DNA, 1026 bp, Streptococcus pneumoniae
atgaaaaacaaattttttctaatagctattttagctatgtgtatagtttttagcgcttgttcttctaattctgttaaaaatgaagaaaatacttctaaagagcatgcgcctgataaaatagttttagatcatgctttcggtcaaactatattagataaaaaacctgaaagagttgcaactattgcttggggaaatcatgatgtagcattagctttaggaatagttcctgttggattttcaaaagcaaattacggtgtaagtgctgataaaggagttttaccatggacagaagaaaaaatcaaagaactaaatggtaaagctaacctatttgacgatttggatggacttaactttgaagcaatatcaaattctaaaccagatgttatcttagcaggttattctggtataactaaagaagattatgacactctatcaaaaattgctcctgtagcagcatacaaatctaaaccttggcaaactttatggagagatatgattaaaattgattcaaaagccttaggtatggaaaaagaaggtgatgagttaatcaaaaatactgaagctcgtatatccaaagaattagaaaaacatccagaaatcaaaggaaaaatcaaaggaaaaaaagtattatttactatgattaatgctgcagatacatcaaaattctggatttatactagcaaagatccaagagcaaattatttaacagatttaggtctagttttccctgaatcattaaaagaatttgagagtgaagatagttttgcaaaggaaatttctgcagaagaagcaaataagataaatgatgctgatgtaatcataacttatggtgatgataaaactcttgaagctttacaaaaagatcctcttttaggtaaaataaatgcaattaaaaatggtgccgttgctgtaattccagataatacaccgttagcagcctcatgcactccaacaccactttcaataaactatactattgaagaatacctaaatcttttaggaaatgcatgcaaaaatgcgaaataa

SEQ ID NO: 118 - DNA, 1035 bp, Streptococcus pneumoniae
atgttaaaggaaataaaaaggagaaacagaatgaaaaataaacgtttaattggaattattgctgcattagcagtcttagtagcaggaagcttgatttattcttcaatgaataaatcagaagctcagaataataaggatgagaagaaaataaccaagattggtgtgcttcaatttgtgagccatccatcccttgatttgatttataaagggatccaagatggacttgcagaagaaggatataaagatgatcaagttaaaattgattttatgaactcagaaggtgaccaaagtaaggttgcgacaatgagtaaacaattggttgcaaatgggaatgaccttgtggttggtatcgcaacaccagcagcccaagggttggctagtgcaacaaaagacctaccggttatcatggccgctattacagacccaattggtgctaacttggttaaagatttgaaaaaaccaggtggcaacgttacaggggtatctgaccacaatccagctcaacaacaagttgaactcatcaaggctctgacaccgaatgtgaaaacaatcggagctctttactcaagtagcgaagacaattcaaaaacacaggtcgaagaatttaaggcttatgctgaaaaagcaggtctgacagtggaaacatttgcagttccttcaacaaatgaaattgcctcaactgtcactgttatgactagcaaggtagatgctatttgggttccaattgataacaccattgcatcaggatttccaacggttgtctctagcaatcaaagttctaagaaaccaatttatcccagtgcgacagctatggtagaagtaggtggtttggcatcagttgtaattgaccaacatgaccttggtgtggcaacaggtaaaatgattgtgcaagtcttgaaaggtgcaaaaccagccgataccccagtcaatgtcttttcaactggtaagtcagtcatcaataaaaaaatagcacaagaactaggtattactattcctgagtctgttctcaaagaagcaggacaagtcatcgaataa

SEQ ID NO: 119 - DNA, 6015 bp, Streptococcus pneumoniae
atggaaaagtattttggtgaaaaacaagagcgtttttcatttagaaaattatcagtaggacttgtatctgcaacgatttcaagtttattttttatgtctgtattagctagttcatctgtggatgctcaagaaactgcgggagttcactataaatatgtggcagattcagagctatcatcagaagaaaagaagcagcttgtctatgatattccgacatacgtggagaatgatgatgaaacttattatcttgtttataagttaaattctcaaaatcaactggcggaattgccaaatactggaagcaagaatgagaggcaagccctagttgctggtgctagcttagctgctatgggaattttaatttttgctgtttccaagaaaaaggttaagaataaaacggtattacatttagtattggttgcagggataggaaatggtgtcttagtttcagtccatgctttagaaaatcatcttttgctaaattacaatacggactatgaattgacctctggagaaaaattacctcttcctaaagagatttcaggttacacttatattggatatatcaaagagggaaaaacgacttctgagtctgaagtaagtaatcaaaagagttcagttgccactcctacaaaacaacaaaaggtggattataatgttacaccgaattttgtagaccatccatcaacagtacaagctattcaggaacaaacacctgtttcttcaactaagccgacagaagttcaagtagttgaaaaacctttctctactgaattaatcaatccaagaaaagaagagaaacaatcttcagattctcaagaacaattagccgaacataagaatctagaaacgaagaaagaggagaagatttctccaaaagaaaagactggggtaaatacattaaatccacaggatgaagttttatcaggtcaattgaacaaacctgaactcttatatcgtgaggaaactatggagacaaaaatagattttcaagaagaaattcaagaaaatcctgatttagctgaaggaactgtaagagtaaaacaagaaggtaaattaggtaagaaagttgaaatcgtcagaatattctctgtaaacaaggaagaagtttcgcgagaaattgtttcaacttcaacgactgcgcctagtccaagaatagtcgaaaaaggtactaaaaaaactcaagttataaaggaacaacctgagactggtgtagaacataaggacgtacagtctggagctattgttgaacccgcaattcagcctgagttgcccgaagctgtagtaagtgacaaaggcgaaccagaagttcaacctacattacccgaagcagttgtgaccgacaaaggtgagactgaggttcaaccagagtcgccagatactgtggtaagtgataaaggtgaaccagagcaggtagcaccgcttccagaatataagggtaatattgagcaagtaaaacctgaaactccggttgagaagaccaaagaacaaggtccagaaaaaactgaagaagttccagtaaaaccaacagaagaaacaccagtaaatccaaatgaaggtactacagaaggaacctcaattcaagaagcagaaaatccagttcaacctgcagaagaatcaacaacgaattcagagaaagtatcaccagatacatctagcaaaaatactggggaagtgtccagtaatcctagtgattcgacaacctcagttggagaatcaaataaaccagaacataatgactctaaaaatgaaaattcagaaaaaactgtagaagaagttccagtaaatccaaatgaaggcacagtagaaggtacctcaaatcaagaaacagaaaaaccagttcaacctgcagaagaaacacaaacaaactctgggaaaatagctaacgaaaatactggagaagtatccaataaacctagtgattcaaaaccaccagttgaagaatcaaatcaaccagaaaaaaacggaactgcaacaaaaccagaaaattcaggtaatacaacatcagagaatggacaaacagaaccagaaccatcaaacggaaattcaactgaggatgtttcaaccgaatcaaacacatccaattcaaatggaaacgaagaaattaaacaagaaaatgaactagaccctgataaaaaggtagaagaaccagagaaaacacttgaattaagaaatgtttccgacctagagttatacagtttgtcaaatggtacttataaacaacacatttcgttagagcaagttccaagcaatccaaatagctactttgttaaagtgaaatcttcttcattcaaagatgtatacctaccagtagcatcaatatcagaggaaagaaaaaatgataaaatcctttataaaatcacagcaaaagtagagaagcttcagcaggagatagaaagcagatataaagataattttaccttctatctagctaagaagggaacagaagaaacaacaaactttacttcctttagtaatctggtcaaagctataaaccaaaatccctctggaacctatcatttagcggccagcctgaatgctaacgaagtggagcttggtcctgatgaaagatcctatatcaaggacacctttactggtcgtttaatcggtgaaaaagatggcaagaattatgctatctataatttgaaaaaacctctgtttgaaaacttgagtggtgctacagtagaaaaactgagtctaaaaaatgttgctatttcagggaaagatgatatcggttcactggcaaatgaagctcagaataacacaaaaattaagcaagttcacgtcgatggtgttctggctggtgaacgtggtatcggtggtttgctggctaaggctgagcaatcaagcatcacagagagcagtttcaagggaagaattatcaacacttatgaaacgactgctgcctacaatatcggtggtatggtcggtcatttgacaggtgacaaggctttacttactaagtcaaaagcgacagtagccatttcatctaacacaaatacttcagatcagactgtgggtggacttgcaggcctagtagaccgagatgcacagatccaagatagctatgctgaaggtgatatcaacaatgtcaagcactttggtagagtcgctggagtggcaggcaatttgtgggatcgaacttctggtgatgttaggcatgctggaagtttgaccaatgttctcagcgatgttaatgtaaccaacggaaatgccatcactggttaccactataacgaaatgaaggtaaaggacacattcagcagcaaggccaacagagtctacaatgtcaccttggtcaaggatgaggtcgtcagcaaggaatcctttgaagaaagaggaacaatgctagatgcttctcaaattgcaagcaaaaaagcagaaatcaatcctctcattttaccaacagtggagccactttcaacaagtggcaaaaaagacagtgatttttctaaggtggcctattatcaagctaagcgcaacttgacttataaaaacattgaaaaattgctacctttctacaacaaggcaaccatcgtcaaatacggaaacctggtcaatgagaacagtcttttatatcaaaaagaactcttgtcagcagtcatgatgaaggacaaccaagtcatcacagacattgtttctaacaaacagactgcaaacaaactcttgcttcactacaaggatgatttatctgagaagctggatctcaaataccagaatgatttcgccaaattagcagaatatagtctgggcaatactggacttctctatacgccaaaccaattcctgtatgaccaaacctctatcatcaagcaagtcttacctgacttacaaaaggttgactatcattcagaagccatcagaaagacgctgggtatttctccaaacgtcaagcaaactgagctctatctagaagaccagttcgccaaaacaaaacaacaactggaagacagtttgaaaaaactcttgtcagcggatgctggactggctagtgctaaccccgtcactgaaggttatcttgtagataaaatcaaacgcaacaaggaagccttgctacttggcttgacctatctggaacggtggtataactttagctatggtcaggtgaatgtcaaagacctagttctgtaccatttggacttctttggtaaggggaatgcttcaccattagatactctgattgagttgggtaaatctggctttaacaatcttctagctaagaataatgtcgatacttatggtatcagtcttgccagtcaacatggaacgacagatttgtttagcacgctggaacattaccgaaaagtctttttaccaaatacaagcaataatgactggtttaaatcagagactaaggcttacattgtcgaagaaaaatccactatcgaagaggtgaaaacgaagcaagggttagctggcaccaagtattctatcggtgtttatgatcgtatcacgagtgccacatggaaataccgcaatatggtcttgcctctcctgaccttgccagagagatccgtatttgtcatctcgaccatgtctagtctaggatttggagcttatgatcgctaccgcagtagtgaccataaagcgggcaaggctctcaatgattttgttgaagaaaatgcgcgtgaaacagccaaacgtcagcgagatcactacgattattggtatcgtattttagacgacaatgcacgtgaaaaactttatagaaatattttgctttacgatgcttataaatttggcgatgataataccgtagggaaagctacagaagtggcagattttgataatccaaatcctgcaatgcaacatttctttggacctgttggaaataaagttgggcataatcaacacggtgcttatgctacaggtgatgcagtttattatatgggttatcgaatgttggataaggatggagctattacttatacgcatgagatgacacatgactcagatcaggacatttatcttggaggatatggtcgaagaagtggcttgggaccagagttctttgctaaaggattattacaagcaccagaccatccagatgatgcgaccattaccatcaactccatcttgaaacattcaaaatctgatagtacagaaagtcgacgattacaagtacttgatccaactacaagatttaataatgcagatgatttgaagcaatatgtccacaacatgtttgacgttgtttatatgttggaatatctcgaaggaaattcaattcttaaattggatacgaatcaaaaacaacaacttcttagaaaagttacaaatgagtaccatcctgatcctgatggaaataaggtctatgcaacaaatgttgtcagaaatctaacagtagaagaagttgaaagactacgttcattcaatgatttgattgataataatattctttcgtctagggaatatgcctcaggtaaatacgaaagaaatggctacttcactattaagttatttgcaccgatttatgctgcattaagtaatgatataggaacaccaggtgacctgatgggacgtcgtatagcctatgaactactagctgctaaaggctttaaagatggtatggtaccatatatctcaaaccaatacgaagaagaagccaaacaaaagggcaagacaatcaatctctacggtaaaacaagaggtttggttacagatgacttggttttggaaaaggtatttaataaccaatatcatacttggagtgagtttaagaaagctatgtatcaagaacgacaagatcagtttgatagattgaacaaagttacttttaatgatacaacacagccttggcaaacatttgccaagaaaactacaagcagtgtagatgaattacagaaattaatggacgttgctgttcgtaaggatgcagaacacaattactaccattggaataactacaatccagacatagatagtgaagtccacaagctcaagagagcaatctttaaagcctatcttgaccaaacaaatgattttagaagttcaatttttgagaataaaaaatag

SEQ ID NO: 120 - DNA, 690 bp, Streptococcus pneumoniae
gtgaaagccattatcttagcagcgggattgggaactcgcttgcgtcctatgactgaaaatacccctaaagccttggttcaggttaatcaaaaacctttgattgagtaccaaattgagtttctcaaagaaaaaggaatcaatgacatcatcatcattgttggttatcttaaagaacaattcgattacttgaaagagaaatacggtgttcgtctcgttttcaatgataaatacgctgactacaataacttttactctctctatcttgtaaaagaagaattggccaacagctatgttattgatgctgacaattatctctttaaaaatatgttccgcaatgatttgacacgttcgacttattttagtgtttatcgtgaagattgtaccaacgaatggttcttggtttatggagatgactacaaggttcaagacattattgttgatagcaaggcaggtcgcatccttagtggtgtatccttctgggatgctccaactgcagaaaagattgtcagctttatcgacaaggcttatgtaagtggtgaatttgttgatctctattgggacaatatggttaaggataatatcaaagagctagatgtctatgttgaagaattagaaggcaatagcatttatgagatcgatagtgtccaagactatcgtaaattagaagaaattcttaaaaacgaaaattaa

SEQ ID NO: 121 - DNA, 855 bp, Streptococcus pneumoniae
atgaagcttgatggctatacacgtttagctgcagttgttgccaatcctattaagcattctatttctcccttcatccacaatagagcctttgaggcgacagctaccaacggtgcttatgtggcttgggagattgaagcgagtgacttggtagaaacagtggccaatattcgtcgctaccagatgtttggcatcaatctgtccatgccctataaggagcaggtgattccttatttggataagctgagcgatgaagcgcgcttgattggtgcggttaatacggttgtcaatgagaatggcaatttaattggatataatacagatggcaagggattttttaagtgcttgccttcttttacaatttcaggtaaaaagatgaccctgctgggtgcaggtggtgcggctaaatcaatcttggcacaggctattttggatggcgtcagtcagatttcggtctttgttcgttccgtttctatggaaaaaacaagaccttacctagacaagttacaggagcagacaggttttaaagtggatttgtgtgctttagaatatgtttctgaactgcaagcaaggattgccgagtcggatttgctagttaatgccaccagtgtgggcatggatggccaatcctctcctgttcctgaaaacatagtcttaccagaaactcttttagttgcagatatcatataccaaccctttgaaacaccgtttttgaaatgggctagaagtcagggcaatccagcagtcaatggtctgggaatgttactctatcaagctgcagaagcttttcaactgtggacaggcaaggaaatgccgacagaagagatttggcagtctttaacagaaaaataccaataa

SEQ ID NO: 122 - DNA, 1071 bp, Streptococcus pneumoniae
atgaaaaaaatctattcatttttagcaggaattgcagcgattatccttgtcttgtggggaattgcgactcatttagatagtaaaatcaatagtcgagatagtcaaaaattggttatctataactggggagactatatcgatcctgaactcttgactcagtttacagaagaaacaggaattcaagttcagtacgagacttttgactccaacgaagccatgtacactaagataaagcagggtggaacgacctacgatattgccattccaagtgaatacatgattaacaagatgaaggacgaagacctcttggttccgcttgattattcaaaaattgaaggaatcgaaaatatcggaccagagtttctcaaccagtcctttgacccaggtaataaattctccatcccttacttctggggaaccttaggaattgtctacaacgaaaccatggtagatgaagcgcctgagcattgggatgacctttggaagccggagtataagaattctatcatgctctttgatggggcgcgtgaggtgctgggactaggactcaattccctcggctacagcctcaactccaaggatctgcagcagttggaagagacagtggataagctctacaaactgactccaaatatcaaggctatcgttgcggacgagatgaagggctatatgattcagaataatgttgcaatcggcgtgaccttctctggtgaagccagccaaatgttagaaaaaaatgaaaatctacgttatgtggtaccgacagaggccagcaatctttggtttgacaatatggtcattcccaaaacagttaaaaaccaaaactcagcctatgcctttatcaactttatgttgaaacctgaaaatgctctccaaaatgcggagtatgtcggctattcaacaccaaacctaccagcgaaggaattgctcccagaggaaacaaaggaagataaggccttctatcccgatgttgaaaccatgaaacacctagaagtttatgagaaatttgaccataaatggacagggaaatatagcgacctcttcctacagtttaaaatgtatcggaagtag

SEQ ID NO: 123 - DNA, 279 bp, Streptococcus pneumoniae
atgaacaaacagtatagttacccactagatttgtcgtggagcactgaagaacttgcttcagtgctttctttttttaatgatgttgaagctgcctatgaaggcaaagtagaggctaaaaagttactggactcctataagggattcaaagcggtcgtgccaagcaagagcgaagagaaacgtttgggacgagaatttgaaacggttagtggctattcactttaccgagcagttcaggctgccaaagaaaaaggggaaggaaagatttctcttggaaagtaa

SEQ ID NO: 124 - DNA, 402 bp, Streptococcus pneumoniae
atgattacactatttctatcaccgagctgtacatcatgtcgtaaggctaaggcctggttagaaaaacataaggttccctttgtggaacacaatattatgaccagtcctttaacaagaaaagaattgcaacacatcctttccttgaccgaaaatggtactgatgacatcatttcaactcgttcaaaaatttttcaaaaattgaatattgatgtagagagtatttcggtatcggaattgcttcatttgattgagcagtatcctagtcttttgcgtcgtccaattattattgatgccaagcgtatgcaaatcggttttaatgaagatgagattcgtgcttttctccctcgtagttatcgtaagcaagaactaaaagaagcaagaatgagagctggtattagttaa

SEQ ID NO: 125 - DNA, 552 bp, Streptococcus pneumoniae
atgaaatctatcggtacgcaaatattacagacagaacgtttgattttaagaagatttgtggagagtgatgcagaagccatgtttcaaaattgggcttcatccgctgagaatctgacctatgttacctgggatccccatcctgatgtcgaaatcactcgaaactcgatttgcaattgggttgcttcctatactaatctcaactattataaatgggccatttgtctaaaagaaaacccagagcaagtaataggagatatcagcattgttaagatagacgaggctgatttaagctgtgaaattggctatgtgttaggcaaggcttactggggaaatggtatgatgacagagactttgaaagctatcttggacttttgttttactcaagcaggttttcaaaaggtcagagcacgttatgccagtctcaacccagcttcaggtcgtgtcatggaaaaggctggaatgtcctatctacaaaccattgttaatggtgtagagagaaaaggctatcttgcggatcttatttattatggtataagtagggaagaatgttga

SEQ ID NO: 126 - DNA, 1392 bp, Streptococcus pneumoniae
atgaataaaagtagactaggacgtggcagacacgggaaaacgagacatgtattattggctttgattggtattttagcaatttctatttgcctattaggcggatttattgcttttaagatctaccagcaaaaaagttttgagcaaaagattgaatcgctcaaaaaagagaaagatgatcaattgagtgagggaaatcagaaggagcattttcgtcaggggcaagccgaagtgattgcctattatcctctccaaggggagaaagtgatttcctctgttagggagctgataaatcaagatgttaaggacaagctagaaagtaaggacaatcttgttttctactatacagagcaagaagagtcaggtttaaagggagtcgttaatcgtaatgtgaccaaacaaatctatgatttagttgcttttaagattgaagagactgaaaagaccagtctaggaaaggttcacttaacagaagatgggcaaccttttacacttgaccaactgttttcagatgctagtaaggctaaggaacagctgataaaagagttgacctccttcatagaggataaaaaaatagagcaagaccagagtgagcagattgtaaaaaacttctctgaccaagacttgtctgcatggaattttgattacaaggatagtcagattatcctttatccaagtcctgtggttgaaaatttagaagagatagccttgccagtatctgctttctttgatgttatccaatcttcgtacttactcgaaaaagatgcggccttgtaccaatcttactttgataagaaacatcaaaaagttgtcgctctaacctttgatgatggtccaaatccagcaacgaccccgcaggtattagagaccctagctaaatatgatattaaagcgactttctttgtgcttgggaaaaatgtttctgggaatgaggacttggtgaagaggataaaatctgaaggtcatgttgttggaaaccatagctggagccatccgattctctcgcaactctctcttgatgaagctaaaaagcagattactgatactgaggatgtgctaactaaagtgctgggttctagttctaaactcatgcgtccaccttatggtgctattacagatgatattcgcaatagcttggatttgagctttatcatgtgggatgtggatagtctggactggaagagtaaaaatgaagcatctattttgacagaaattcagtatcaagtagctaatggctctatcgttttgatgcatgatattcacagtccgacagtcaatgccttgccaagggtcattgagtatttgaaaaatcaaggttatacctttgtgaccataccagagatgctcaatactcgcctaaaagctcatgagctgtactatagtcgtgatgaataa

SEQ ID NO: 127 - DNA, 837 bp, Streptococcus pneumoniae
atgaaaaaatggatgcttgtattagtcagtctgatgactgctttgttcttagtagcttgtgggaaaaattctagcgaaactagtggagataattggtcaaagtaccagtctaacaagtctattactattggatttgatagtacttttgttccaatgggatttgctcagaaagatggttcttatgcaggatttgatattgatttagctacagctgtttttgaaaaatacggaatcacggtaaattggcaaccgattgattgggatttgaaagaagctgaattgacaaaaggaacgattgatctgatttggaatggctattccgctacagacgaacgccgtgaaaaggtggctttcagtaactcatatatgaagaatgagcaggtattggttacgaagaaatcatctggtatcacgactgcaaaggatatgactggaaagacattaggagctcaagctggttcatctggttatgcggactttgaagcaaatccagaaattttgaagaatattgtcgctaataaggaagcgaatcaataccaaacctttaatgaagccttgattgatttgaaaaacgatcgaattgatggtctattgattgaccgtgtctatgcaaactattatttagaagcagaaggtgttttaaacgattataatgtctttacagttggactagaaacagaagcttttgcggttggagcccgtaaggaagatacaaacttggttaagaagataaatgaagctttttctagtctttacaaggacggcaagttccaagaaatcagccaaaaatggtttggagaagatgtagcaaccaaagaagtaaaagaaggacagtaa

SEQ ID NO: 128 - DNA, 432 bp, Streptococcus pneumoniae
atgacgattttgtttgtggttatcagtggttcctttctgtatatggtttctcttagcatgaaaccctatcaaacagctaaaagtgaaggagaaaaattagctcagcagtatgcaggattagagcaggctgatcaggttgatttatacaatggcttggaatcttattacagcgttcttggtcgtaacaaacagcaagaagcgcttgctgtcctgattggtaaagatgaccataagatttacgtttatcagctaaatcagggtgtttcacaagaaaaagcagaaacggtttctaaggaaaagggagctggcgagattgacaagataacctttggccgttatcaagataagccaatctgggaagttaagtcaggatctgatttttatctagtagattttgaaacaggagcattggtcaacaaggagggcctatga

SEQ ID NO: 129 - DNA, 780 bp, Streptococcus pneumoniae
atgaaaaaaaatagtttatatatcatatcctcactcttttttgcttgtgtcttatttgtctatgctacggcgacgaattttcaaaacagtaccagtgctaggcaggtaaaaacggaaacctatactaatacagtaacaaatgtccctattgacatacgctataatagtgataagtattttattagcggttttgcttcagaagtatcagtggtcttgactggtgcaaatcgcctatcgctagctagtgaaatgcaagaaagtacacgtaaattcaaggttactgctgacctaacagatgccggtgttggaacgattgaagttcctttgagcattgaagatttacccaatgggctgaccgctgtggcgactccgcaaaaaattacagtcaagattggtaagaaggctcagaaggataaggtaaagattgtaccagagattgaccctagtcaaattgatagtcgggtacaaattgaaaatgtcatggtgtcagataaagaagtgtctattacgagtgaccaagagacattggatagaattgataagattatcgctgttttgccaactagcgaacgtataacaggtaattacagtggttcagtacctttgcaggcaatcgaccgcaatggtgttgtcttaccggcagttatcactccgtttgatacaataatgaaggtgactacaaaaccagtagcaccaagttcaagcacatcaaattcaagtacaagcagttcatcggagacatcttcgtcaacgaaagcaactagttcaaaaacgaattaa

SEQ ID NO: 130 - DNA, 750 bp, Streptococcus pneumoniae
atgttttatacttatttgcgtggattagttgtattgctcttatggtccatcaatggcaatgctcactatcataatactgataaaattcctaatcaagatgaaaattatattttagttgcgcctcaccgtacctggtgggatcctgtttatatggcctttgcgaccaagccaaaacagttcatctttatggcaaaaaaagaactctttaccaaccgtatctttggttggtggattcgtatgtgtggcgcctttcccatcgaccgtgaaaatcccagcgcctcagccatcaaatatcctatcaacgttctcaaaaaaagtgaccgctctctcatcatgtttccaagtggtagccgccactcaaacgatgtcaaggggggcgcagcactgattgccaaaatggccaaggtccgtatcatgccggttacctacaccggtcccatgactttgaagggcttgattagccgtgaacgtgtcgatatgaactttggaaatccaatcgatatctcagatatcaagaaaatgaatgatgaaggcattgaaacagtcgccaatcgtattcaaacagaattccaacgtctggacgaagaaacgaaacaatggcacaatgataaaaaaccaaatccactctggtggtttatccgcatccctgccctcatccttgctattatcctcgctatcctaaccatcatctttagctttatcgcaagcttcatctggaacccagataagaaaagagaagaacttgcatag

SEQ ID NO: 131 - DNA, 2775 bp, Streptococcus pneumoniae
atgccagtgtcaaggatgtggtgctcaaccagcatcctcaggatattgacagtttggagtactagcatgatcaagcgaaaaacttattggaaggacttagttcagtccttcacaggctccaaggggcgttttttatccatcttgatcctgatgatgttgggatctctagccttagtaggcctcaaagtaaccagtcccaacatggaggcgacagctaatgcttatttaacaactgctcaaaccttggatttggcagtcatgtctaactatggcttggatcaagcagaccaagaagaactaaaacagacggagggcgcagaggtcgagtttggctatttgacagatgtgactatggataatgggcaggatgccattcggctgtactccaaaccagagcgaatttcaacctttcagctaagaaagggacgacttcctcagtcagacaaggaaatcgctttggccactcatttgcaaggccaatacagcgtgggacaggagattagttttaaagaaaaagaagagggtcattcctctttaaaagaccatacttataccattactggttttgtggattcggctgaaatcctctcccagcgagatatgggctacgcaggaagtggaagtgggactctgacagcctatggggtgattttacctagtcaatttgatcagaaagtctacaatatagctcgtttgaaatatcaagatttagcgggtttaaatgccttttcatcagcttatgaagaaaaatccaagcaacatcaagaagagcttgaacaaattttatcagataatggcaaggtacgtctgcaacttttgaaaaaagaaggacaagagtctctagacaaggggcaagagacccttgacaaggctcagactaatttgcaggaaggcaagcgtcgtttagcagctgctcaagctcgtatacaggctcaagaaagtcaactagccttgtttcctcaagttcagagagagcaggctagtgctcaacttacccaagccaagcaggaattgggcaaggaagaggacaaactaaagcaagctgaacaaaatctagcccaagaaaaggaaaaattagaaaaacatcagcaagtcttggatgatttggcggagccaaggtatcaggtttataatcgtcagaccatgccaggtggtcagggctatcttatgtatagcaatgcttcatccagtattcgagcagtgggcaatatctttcctgtggtactttatgccgtagcagccatggtgacctttacgaccatgactcgctttgtagacgaagagcgaactcatgcagggatttttaaggccttgggttatcgtagtaaggatattatcgccaagtttctcctttatggactagtagctgggactgtcggaacggctctaggtagtatacttggtcattatttgctagccagtgtaatttcaagtgtcattacaaaaggcatggtggtgggagaaactcagattcagttctattggacctatagcttactagcttttgtcttgagcttgttggcgagtgtgttaccagcctatctggtggcttggagggaacttcatgacgaagcagcccagcttctacttcctaaacctcctgtcaaaggagctaaaatcttattggagcgtatcggttttatctggcgtcgtctcagttttactcataaggtaacagcccgcaacatctttcgttataagcagagaatgttgatgacaatctttggtgtggcaggttctgtagctctgctctttgcaggtttgggaatccaatcttctgtagcaggagttccgtctaaacagtttcaacaaatccaacagtatcagatgcttgtctctgaaaatcctagtgcgaccaatcaggacaaggtagagctagcagaagtgttgaaagggcaggagatactagcctaccagaaaatctattctaaagcgctatacaaggatttcaaaggcaaagctggtcttcaaaacattactcttatgatgatagagaaggaagatttgactccctttatccatcttcaacatcatcagcaggagctgacattaaaagatggcatcgttattacagctaaactcgcccagctggcaggtgtcaaggttgggcagactttagaaattgaaggtaaggaactaaaggtcgttgctattactgagaactacgttggtcactttatttatatgagtcaggctagctatgagcaactttacggacagctaccccaagccaacacttatctggtctcattaagggataccagtgcaactagtatcgaaagtcaggcgggcttgcttatgaatcaatctgcggtgtccagcgttgtccaaaatgcttcagccattcgactcttcgactctatcgctagctcactcaatcagaccatgaccatcttggtcatcgtatcggttctattagctattgtcatcctttacaatctgaccaatatcaacgtagctgagagaatccgtgaactctccactatcaaggttcttggttttcataataatgaagtcaccctctacatttaccgtgagacgattgtgctgtcccttgtgggaatcgtacttggtctgatagctggtttctatttacaccaatttttgattcaaatgatttcgcctgcgactattctcttttatccgcaggtaggctgggaagtctatgtaatcccagtggcagcagtaagcatcattttgaccttgcttggtttcttcgtcaattattatctgagaaaggttgatatgttagaagccctgaaatctgtagagtaa

SEQ ID NO: 132 - DNA, 1329 bp, Streptococcus pneumoniae
atgaaatttagaaaattagcttgtacagtacttgcgggtgctgcggttcttggtcttgctgcttgtggcaattctggcggaagtaaagatgctgccaaatcaggtggtgacggtgccaaaacagaaatcacttggtgggcattcccagtatttacccaagaaaaaactggtgacggtgttggaacttatgaaaaatcaatcatcgaagcgtttgaaaaagcaaacccagatataaaagtgaaattggaaaccatcgacttcaagtcaggtcctgaaaaaatcacaacagccatcgaagcaggaacagctccagacgtactctttgatgcaccaggacgtatcatccaatacggtaaaaacggtaaattggctgagttgaatgacctcttcacagatgaatttgttaaagatgtcaacaatgaaaacatcgtacaagcaagtaaagctggagacaaggcttatatgtatccgattagttctgccccattctacatggcaatgaacaagaaaatgttagaagatgctggagtagcaaaccttgtaaaagaaggttggacaactgatgattttgaaaaagtattgaaagcacttaaagacaagggttacacaccaggttcattgttcagttctggtcaagggggagaccaaggaacacgtgcctttatctctaacctttatagcggttctgtaacagatgaaaaagttagcaaatatacaactgatgatcctaaattcgtcaaaggtcttgaaaaagcaactagctggattaaagacaatttgatcaataatggttcacaatttgacggtggggcagatatccaaaactttgccaacggtcaaacatcttacacaatcctttgggcaccagctcaaaatggtatccaagctaaacttttagaagcaagtaaggtagaagtggtagaagtaccattcccatcagacgaaggtaagccagctcttgagtaccttgtaaacgggtttgcagtattcaacaataaagacgacaagaaagtcgctgcatctaagaaattcatccagtttatcgcagatgacaaggagtggggacctaaagacgtagttcgtacaggtgctttcccagtccgtacttcatttggaaaactttatgaagacaaacgcatggaaacaatcagcggctggactcaatactactcaccatactacaacactattgatggatttgctgaaatgagaacactttggttcccaatgttgcaatctgtatcaaatggtgacgaaaaaccagcagatgctttgaaagccttcactgaaaaagcgaacgaaacaatcaaaaaagctatgaaacaatag

SEQ ID NO: 133 - DNA, 1068 bp, Streptococcus pneumoniae
atgaaaaaaatgaaagtttggtctactgtacttgcaacgggagttgctcttactacacttgctgcttgctctggaggttcaaattctacgactgcttcttcatctgaagaaaaagctgataaaagtcaagaattagttatctattcgaactcagtctcaaatggtcgtggtgattggttaactgctaaagcaaaagaagctggttttaatataaaaatggttgatatcgctggcgctcaattagcagaccgtgttattgctgagaagaataatgcagttgcagatatggtatttggaattggtgctgttgattcaaataaaattagagatcaaaaattactagtacagtacaagcctaaatggttagataaaattgatcaatctttatcagataaagataattattataatcctgtgattgttcaaccattagttttaattggggcgcctgatgtaaaagaaatgcctaaagattggactgaattaggtagtaagtataaaggtaaatattcaatttctggtcttcaaggaggtacaggacgggcaattctagcaagtatcttagttcgataccttgatgataaaggtgaattaggtgtttccgaaaaaggttgggaagtagcaaaagaatatttgaaaaatgcatacactcttcaaaagggagaaagttcaattgttaagatgttagacaaagaagatccaatacaatatggaatgatgtggggttctggtgcattagttggacaaaaagaacaaaatgttgttttcaaagttatgactcctgagattggtgtaccatttgtaactgaacaaactatggttttaagcactagtaaaaaacaagcgttagctaaagaatttattgattggtttggtcaatcagaaattcaagtagaatatagtaagaactttggatctattcctgcaaataaagatgccctcaaagatctacctgaagatacgaagaaatttgttgatcaagtgaaaccacaaaatattgactgggaagctgttggaaagcatttggatgaatgggtagaaaaagctgaattagaatacgtacaataa

SEQ ID NO: 134 - DNA, 966 bp, Streptococcus pneumoniae
atgaaaacatcccttaaactttatttcactgccctagtggccagcttcttgctcctacttggtgcatgtagtacaaactcaagcactagtcagacagagaccagtagctctgctccaacagaggtaaccattaaaagttcactggacgaggtcaaactttccaaagttcctgaaaagattgtgacctttgacctcggcgctgcggatactattcgcgctttaggatttgaaaaaaatatcgtcggaatgcctacaaaaactgttccgacttatctaaaagacctagtgggaactgtcaaaaatgttggttctatgaaagaacctgatttagaagctatcgccgcccttgagcctgatttgattatcgcttcgccacgtacacaaaaattcgtagacaaattcaaagaaatcgccccaaccgttctcttccaagcaagcaaggacgactactggacttctaccaaggctaatatcgaatccttagcaagtgccttcggcgaaactggtacacagaaagccaaggaagaattgaccaagctagacaagagcatccaagaagtcgctactaaaaatgaaagctctgacaaaaaagcccttgcgatcctccttaatgaaggaaaaatggcagcctttggtgccaaatctcgtttctctttcttgtaccaaaccttgaaattcaaaccaactgatacaaaatttgaagactcacgccacggacaagaagtcagctttgaaagtgtcaaagaaatcaaccctgacatcctctttgtcatcaaccgtacccttgccatcggtggggacaactctagcaacgacggtgtcctagaaaatgcccttatcgctgaaacacctgctgctaaaaatggtaagattatccaactaacaccagacctctggtatctaagcggaggcggacttgaatcaacaaaactcatgattgaagacatacaaaaagctttgaaataa

SEQ ID NO: 135 - DNA, 1980 bp, Streptococcus pneumoniae
atgaaaaaaaatcgtgtatttgctacagcaggtcttgttttattagcagcaggtgtacttgcagcatgcagttcttcaaaatcatctgattcatcagcccctaaagcttatggctatgtttatacagcagacccagaaaccttggactacctgatttcaagtaaaaatagtacaacagtagtgacttcaaatgggattgatggtttattcactaacgataattacggtaatcttgctcctgcagttgcagaggattgggaagtctctaaggatggtttgacctacacttataagattcgtaaaggggttaaatggtttacctctgatggagaagaatatgcagaggtgacggctaaagatttcgtgaacggtttaaaacacgcagcagataaaaaatcagaagctatgtatttagctgaaaattcggttaaaggcttggcagattatctatcaggaacttcaacagatttttcaacagttggtgtcaaggcggttgatgattatacgttacaatacactttgaaccagcctgaaccgttctggaactctaagttgacctattctattttctggcctctgaatgaagaattcgaaacatcaaaaggaagcgattttgctaaaccaacagatccgacatccttgctttataatggtccattcttgttgaaagggttgactgcaaaatcttctgtagagtttgtaaaaaatgagcaatattgggataaagaaaatgtccacctagatactatcaatctagcttactatgatggatcagatcaggagtcgctagagcgtaacttcactagtggagcttatagttatgcccgtctttaccctaccagctccaactattctaaggttgcagaagaatacaaggacaatatctattacacacaatcaggctctgggattgctggtctgggtgtgaatattgatcgccaaagttacaactatacttctaaaactacagattcagagaaagtagctactaagaaggcattgcttaacaaagatttccgtcaagccttgaattttgctcttgatcgctcagcttactcagctcaaatcaatggtaaagatggagcagctttagcagttcgtaatttatttgtaaaaccagactttgtttcagctggtgagaagacctttggtgatttagtcgctgctcaacttcctgcttatggtgatgagtggaaaggtgtgaatttagctgatgggcaggatggtttattcaatgctgacaaggccaaggcagagtttgcgaaagctaagaaagctttagaagcagacggcgttcagtttcctattcatctggacgttccagtagaccaagcatcaaaaaactacatatctcgtattcagtcctttaaacaatctgtagaaacagttcttggtgttgaaaatgtcgttgttgatattcaacaaatgacaagtgatgaattccttaatattacttactatgctgccaatgcttcatctgaggattgggatgtatcaggaggagtttcatgggggccagactatcaagacccatctacttacctggatattttaaaaacaactagcagtgaaactacaaaaacatatttaggatttgataatccaaatagcccttcagtagttcaagttggtttgaaagaatacgataaattagttgatgaagctgccagagagacaagcgacttgaatgtccgttatgaaaaatatgcagcggctcaagcatggttgacagatagttcactctttattcctgctatggcttcttctggtgcagcaccagtgctttcacgaattgttccatttactggagcttctgcgcaaacaggctctaaggggtcagatgtttacttcaaatatttgaaatcacaagataaagtggtgactaaggaagagtatgaaaaagctcgtgaaaaatggttgaaagaaaaagctgaatcaaatgagaaagctcaaaaagaattggcaagtcatgtgaagtaa

SEQ ID NO: 136 - DNA, 1260 bp, Streptococcus pneumoniae
atggaatggtataaaaaaatcggacttcttgcaactacaggtttagctttgtttgggctcggcgcttgctccaactatggtaaatctgcggatggcacagtgaccatcgagtatttcaaccagaaaaaagaaatgaccaaaaccttggaagaaatcactcgtgattttgagaaggaaaaccctaagatcaaggtcaaagtcgtcaatgtaccaaatgctggtgaagtattgaagacacgcgttctcgcaggagatgtgcctgatgtggtcaatatttacccacagtccatcgaactgcaagaatgggcaaaagcaggtgtttttgaagatttgagcaacaaagactacctgaaacgcgtgaaaaatggctacgctgaaaaatatgctgtaaacgaaaaagtttacaacgttccttttacagctaatgcttatggaatttactacaacaaagataaattcgaagaactgggcttgaaggttcctgaaacctgggatgaatttgaacagttagtcaaagatatcgttgctaaaggacaaacaccatttggaattgcaggtgcagatgcttggacactcaatggttacaatcaattagcctttgcgacagcaacaggtggaggaaaagaagcaaatcaataccttcgttattctcaaccaaatgccattaaattgtcggatccgattatgaaagatgatatcaaggtcatggacatccttcgcatcaatggatctaagcaaaagaactgggaaggtgctggctataccgatgttatcggagccttcgcacgtggggatgtcctcatgacaccaaatgggtcttgggcgatcacagcgattaatgaacaaaaaccgaactttaagattgggaccttcatgattccaggaaaagaaaaaggacaaagcttaaccgttggtgcgggagacttggcatggtctatctcagccaccaccaaacatccaaaagaagccaatgcctttgtggaatatatgacccgtccagaagtcatgcaaaaatactacgatgtggacggatctccaacagcgatcgaaggggtcaaacaagcaggagaagattcaccgcttgctggtatgaccgaatatgcctttacggatcgtcacttggtctggttgcaacaatactggaccagtgaagcagacttccataccttgaccatgaactatgtcttgaccggtgataaacaaggcatggtcaatgatttgaatgccttctttaacccgatgaaagcggatgtggattag

SEQ ID NO: 137 - DNA, 1017 bp, Streptococcus pneumoniae
atggttaaaaaaattattggaatggtgctagctttactttctgtaactgtagtaggagtaggtgtttttgcttatactatttatcaacaagggacagaaaccttagctaaaacctataaaaaaatcggtgaagaaaccaaggttattgaagcgactgaacctctaaccattctgttaatgggagtggacaccggaaatgttgaacgaactgaaacttgggtcggtagaagtgatagcatgatcttgatgacagtgaatcctaaaacgaaaaaaacaacaatgatgagtttagagcgggatattctgacgcgcattgaatcagggaatggtcaggctcatgaagcgaaactgaactcagcatatgcagatggtggagcagagcttgctatagaaaccattcaaaaaatgatgaatatccatattgatcgctatgtgatggtcaatatgagaggattgcaaaaactagtggatgcagtaggaggtattacagtcaataatatcctaggtttcccaatttctatcagtgaccaagaagaatttaatactatttctatcggtgttggggagcaacatattgggggagaagaagccctagtctatgcacgaatgcgttaccaagatcctgagggggattatggtcgtcaaaaacgtcaacgtgaagttattcaaaaagtcatggaaaaagctctcagtttaaatagcattggtcattatcaagagattctaaaagctttgagtgacaatatgcagaccaatattgatttgtctgcaaaaagtatccctaacttgctaggctataaagattcatttaaaaccattgaaactcagcagttgcagggtgaaggagagatacttcaaggtgtttcttaccagattgtttcgagagcacatatgttggaaatgcaaaatctactccgacgttctttgggacaagaagaagttactcagcttgaaaccaatgcggttttatttgaagatttatttggcagagcacctgttggtgatgaagataattaa

SEQ ID NO: 138 - DNA, 1284 bp, Streptococcus pneumoniae
atggataaaattgtggttcaaggtggcgataatcgtctggtaggaagcgtgacgatcgagggagcaaaaaatgcagtcttacccttgttggcagcgactattctagcaagtgaaggaaagaccgtcttgcagaatgttccgattttgtcggatgtctttattatgaatcaggtagttggtggtttgaatgccaaggttgactttgatgaggaagctcatcttgtcaaggtggatgctactggcgacatcactgaggaagccccttacaagtatgtcagcaagatgcgcgcctccatcgttgtattagggccaatccttgcccgtgtgggtcatgccaaggtatccatgccaggtggttgtacgattggtagccgtcctattgatcttcatttgaaaggtctggaagctatgggggttaagattagtcagacagctggttacatcgaagccaaggcagaacgcttgcatggtgctcatatctatatggactttccaagtgttggtgcaacgcagaacttgatgatggcagcgactctggctgatggggtgacagtgattgagaatgctgcgcgtgagcctgagattgttgacttagccattctccttaatgaaatgggagccaaggtcaaaggtgctggtacagagactataaccattactggtgttgagaaacttcatggtacgactcacaatgtagtccaagaccgtatcgaagcaggaacctttatggtagctgctgccatgactggtggtgatgtcttgattcgagacgctgtctgggagcacaaccgtcccttgattgccaagttacttgaaatgggtgttgaagtaattgaagaagacgaaggaattcgtgttcgttctcaactagaaaatctaaaagctgttcatgtgaaaaccttgccccacccaggatttccaacagatatgcaggctcaatttacagccttgatgacagttgcaaaaggcgaatcaaccatggtggagacagttttcgaaaatcgtttccaacacctagaagagatgcgccgcatgggcttgcattctgagattatccgtgatacagctcgtattgttggtggacagcctttgcagggagcagaagttctttcaactgaccttcgtgccagtgcggccttgattttgacaggtttggtagcacagggagaaactgtggtcggtaaattggttcacttggatagaggttactacggtttccatgagaagttggcgcagctaggtgctaagattcagcggattgaggcaagtgatgaagatgaataa

SEQ ID NO: 139 - DNA, 1038 bp, Streptococcus pneumoniae
atgaaaaaaaagattagatggcccttatacgtcattgcggccttgattgtgactttcttggcatttgtagtgcccttgccttattatatagaggttccaggtggttcggaagatattcgccaagtccttaaagtaaatgacacagaagataaggaagctggtgcctatcaattcgttacggttggtgttcaacatgccactttagctcatatgatttatgcttggttgacaccttttacagatattcgtagtgctcaggagactacaggtggttcttccgatgttgaatttatgcgaatcaatcaattctacatgcaaacatcgcaaaatatggccaagtatcaaggactaaaaacagctggtaaggatatcgaactcaagtactttggagtttatgttttgaatgtgacggataattcaacctttaaagggattctcaatatctctgatacagtcacagcagtcaatgatcagacctttgatagttccaaagacttgattgattacgtcagttctcaaaaattaggggattccgtcaaggtcacctatgaagaggatgggcaaaccaagtctgcagaaggaaaaatcatcaccttggaaaatggcaaaaatggaattggaatcggcttgattgaccgtacagaggtaatcagcaatgtcccaattagcttttcaacagctggtattggcggtccaagtgctggtctcatgtttagtctagctatctatactcaaatagctcacccagatcttcgtaatggtcgtattgttgccggtacaggtaccattgaccgcgatggtaatgtgggagacattggaggtattgataagaaggttgtagcttcggctagggcaggtgctgctattttctttgctcctgataaccctgttagcgaagaagaacaaaaggcgcatccggacgcgaaaaacaactaccaaacagccctagaagcggctaaaacaatcaagacggatatgaaaatcgtgcccgttaaaaccctacaagatgcgattgattacttgaaaaacaatccctaa

SEQ ID NO: 140 - DNA, 963 bp, Streptococcus pneumoniae
atgcctaagaaaatccttgttttacatacgggtggaactatttccatgcaggccgatgcttctggcgctgttgtgacgagttcagataatcccatgaaccatgtgtccaacccacttgaaggaatccaagtccacgccttggacttttttaaccttccaagtccccatatcaaacccaaacatatgctggtcctctaccagaaaattaaagaggaagcagataactacgatggagtggtgatcacacacggaaccgatactttagaggaaacagcctatttccttgataccatggaagttccccatatgcctatcgttctaacaggagccatgcgtagctccaatgagctcggtagtgatggtgtttataattacctaagtgctttacgagtggccagcgatgacagggctgctgacaaaggagttttggtcgttatgaacgatgaaatccacgctgccaagtatgtcaccaaaacacatacgactaatgtcagcaccttccagactccaacacatggcccccttggtctcatcatgaaacaggaaatcctctacttcaaaacagctgaacctcgtgttcgctttgaccttgatcacatacaaggtttagtccctatcatctcggcttatgctggtatgacagatgagctgattgatatgctggatttagaacacttggacggtttgattatccaagccttcggagctggtaatattcccaaagaaacggctcaaaaattagaaagccttctgcaaaaaggaattccagtcgctctggtatcacgatgctttaacggtattgccgagcctgtttatgcataccagggtgggggcgtacagttgcaaaaagcaggcgttttctttgttaaagaactcaacgcccaaaaagctcgcttgaaactcctcatcgccctcaatgccggactaacaggacaggctttgaaagactatatggaaggctaa

SEQ ID NO: 141 - DNA, 462 bp, Streptococcus pneumoniae
atggttcagaacagttgttggcaatcaaagagccataaggtcaaggcttttaccttgttagaatccctgcttgccctcattgtcatcagtgggggattactcctttttcaagctatgagtcagctcctcatttcagaagttcgctaccagcaacaaagcgagcaaaaggagtggctcttgtttgtggaccaacttgaggtagaattagaccgttcgcagttcgaaaaagtagaaggcaatcgcctatacatgaagcaagatggcaaggacatcgccatcggtaagtcaaagtcagatgatttccgtaaaacgaatgctcgtggtcgaggttatcagcctatggtttatggactcaaatctgtacggattacagaggacaatcaactggttcgctttcatttccagttccaaaaaggcttagaaagggagttcatctatcgtgtggaaaaagaaaaaagttaa

SEQ ID NO: 142 - DNA, 405 bp, Streptococcus pneumoniae
atgattaaggcctttaccatgctggaaagtctcttggttttgggacttgtgagtatccttgccttgggcttgtccggctctgtccagtccactttttcagcggtagaggaacagattttctttatggagtttgaagaactctatcgggaaacccaaaaacgcagtgtagccagtcagcaaaagactagtctgaacttagatgggcagacgcttagcaatggcagtcaaaagttgccagtccctaaaggaattcaggccccatcaggccaaagtattacatttgaccgagctgggggcaattcgtccctggctaaggttgaatttcagaccagtaaaggagcgattcgctatcaattatatctaggaaatggaaaaattaaacgcattaaggaaacaaaaaattag

SEQ ID NO: 143 - DNA, 1332 bp, Streptococcus pneumoniae
atgaaacgctaccttcaattttggctagtcaatctaagtgttagcctcattctgattgcagggatggcattaacttggatcagtaaaggcatcggtctctttcttctagccctttctttgggactaggtggctactggctcttttgcctttggaaatgggaagttgcttttgagaccttgcaccaacctctcttgaccagtagtgaatactttttagaaaaagggcaagaagacttaaagtctttggctcagtatgtgtctggcctaaaaaccaaagtctcccaacaggatcagcaatacaaggatctagccgaaacaatggaggttcttctgtcgcacctaaccatggggacgtttttagtttccgctcaaggtcagatgttattatccagtcgctctctgcctcattattttcccgatgtggacggcgacataagttcacttgatgacctcaaacggatggatattcggaatttagttcaccaagcctttgatcaaaaaacaaggttaaaacaagaagtaagtgggtttcatgagggtgacttgattttagaagtgacagcagttcccgtttttagccccacccaatctgtggaagctgtgctcgtcttgctatatgatttaacaacgattagaacttatgaaaagttaaatttagcctttgtctcaaatgcctcccatgaattgaggacaccagttacttcgattaagggctttgctgaaaccattaaggggatgtcagctgaagaagaagcgctcaaggatgactttctagacattatttacaaagaaagtttgcgtcttgagcatattgttgagcatcttcttaccttatctaaggctcaacaaatgcctatacaatggacgaccctttctttggcagaatttgtacaggatttgactcaaagcttgcaacctcagctcaagaagaaggatttacagctaaaggtgcaggtgccagatgatgtcaccctcgtatcagatagtcaattactttcccaaatcttactcaatcttttatccaatgccatccgttacactgaacaagggggaaaaattgaggtcaagacccaaaaggtgaacgaaggcattaagatttctgtatcagatacagggattggtattagtcaattagagcaggatcgtatttttgaacgtttttaccgagttaataaaggtcgaagcagacaaactggtggcactggtcttggccttgccattgtcaaagaactcagtcaattattaggtggccaagtcacggtgacgagtcagcttggcagaggcagttgcttcacgatttttcttcctaaccaatctttcgcacaggactaa

SEQ ID NO: 144 - DNA, 876 bp, Streptococcus pneumoniae
atgaaattcaaaaaaatgcttactcttgcagccattggcttatcaggatttgggcttgttgcctgtggcaatcagtcagctgcttccaaacagtcagcttcaggaacgattgaggtgatttcacgagaaaatggctctgggacacggggtgccttcacagaaatcacagggattctcaaaaaagacggtgataaaaaaattgacaacactgccaaaacagctgtgattcaaaatagtacagaaggtgttctctcagcagttcaagggaatgctaatgctatcggctacatctccttgggatctttaacgaaatctgtcaaggctttagagattgatggtgtcaaggctagtcgagacacagttttagatggtgaataccctcttcaacgtcccttcaacattgtttggtcttctaatctttccaagctaggtcaagattttatcagctttatccactccaaacaaggtcaacaagtggtcacagataataaatttattgaagctaaaaccgaaaccacggaatatacaagccaacacttatcaggcaagttgtctgttgtaggttccacttcagtatcttctttaatggaaaaattagcagaagcttataaaaaagaaaatccagaagttacgattgatattacctctaatgggtcttcagcaggtattaccgctgttaaggagaaaaccgctgatattggtatggtttctagggaattaactcctgaagaaggtaagagtctcacccatgatgctattgctttagacggtattgctgttgtggtcaataatgacaataaggcaagccaagtcagtatggctgaacttgcagacgtttttagtggcaaattaaccacctgggacaagattaaataa

SEQ ID NO: 145 - DNA, 651 bp, Streptococcus pneumoniae
atgagaaatcaatttgacttagaattgcatgaattagaacaatcctttttaggactagggcaacttgtccttgaaacagcttcaaaagccttactggccttagcctccaaagacaaggagatggcagagctaattatcaataaggatcatgctatcaaccaaggtcaaagcgctatcgaattgacctgtgcccgtttgttggccttgcagcagccacaagtgtctgaccttcgatttgtgattagcatcatgtcttcttgttcagaccttgaacgtatgggagaccatatggcaggcattgccaaagctgttttgcaactaaaagaaaatcaactagcccctgacgaagaacagttacaccaaatgggtaaattatccctcagcatgctagccgatttattggttgcctttcctttgcaccaagcctcaaaagctattagtattgctcaaaaagatgaacagattgaccaatattattatgccttatcaaaggaaatcattggacttatgaaagaccaagaaacctcaattcccaatggaactcaatacctttatatcatagggcatctggaacgcttcgctgattacattgctaacatttgtgaacgcctagtctacctagaaacaggagaactagtggatttgaattaa

SEQ ID NO: 146 - DNA, 2085 bp, Streptococcus pneumoniae
atgaaaccactacttgaaaccatcgatacccgctttggaactaccaacaagcatgccttttctcggggaaataccctgccatacacaggcgtgccttttgggatgaattactttgtgccccagaccagtgaccaggatggatcttggttttttgatccacatctgcctatctttcaggggattcgattaactcaccagcccagtccttggattggggactactcttggctccttctgacacctgtcaccagtcaactggggggagacagcctctttcaccgccagtcttcttatgatatagataaagcttgcttccagcctcactatttgaagctcttttctctgcgttatcagattgaaacccagctcacaccgacttgctatggtgcttctattcgtttgaatcaaaagcaaggcaaagccctctccctctatcttcacgcagcagatgaactgacagtagagcaagtagataagcggactcttgccctgcgacaagaaggtaaaactgaaactaacaaaaattcgctaacgatgttcactgccctgcaaatgaacacggatattcttgctatcagccaagaagctggagactggcgaattgacttagcaagtagtcaaaccgagatgcaactagccacttctttcatctctccttctcaagctctaatcaatctacctcaagaagattttgatagctgtaaatcaagtgcccaagtggattgggaaaatctcctccatcgttttgacattatagagacaggagaggctgaccgaaccttctttgaccactgcctctacagactcttcctcttcccacagactttttatgagattaatgaatcagggcaagccatccacatggatctggctactggtactgtcaagcctggtgtcctctttagcaacaatggtttctgggataccttccgcaccaccttccccctctttgcccttatcataccggagcactatcaacgctttttagaaggtttcctcaatagctaccgcgatactggtttccttccaaaatggctggctccagatgaacggggtatgatgccaggtacacttttagacggtattatcgcagatagcgcctgcaaggacatgacccccgacctagaaggagaactcttccaagccatgctcgaaacagccagcaaagccgaccctctcggcatcaatggccgccacggactagcccaataccaagaactaggttacctctctaccgaccaccacgaaagtgttagccatactctagactatgcctatagtgacttttgtatcgccagctgtgccaaaaaactagagaacatagaaatcgctgaaacctacaaggctgcttcacaaaattaccgccagctatttgacgctgagacaggttacatgcgagcacgagacaatcaaggaaactttcaccctgacttctctccttatagttgggggcgagactacgctgaatgctctgccattcaagctactttaggcgttctccacgacatccctggcttaatccaactgatgggtggaaaagaaacctttagcaactatcttttgaaagcctgtcaagatgctcccctctttgaaacaacaggctatggttacgaaattcacgaaatgagcgagatggctactgctccttttggacaaatagccatttccaaccagcctagtttccacattccttatctcttccgttacagcgattaccctgactacactgcccttcttatcaagacgctccgtcagaaagcttttcacccaagttgggaagcctatcctggagatgaagacaatggtagtctctctgcttggtacatctggtcagctctcggattttatccaacctgtccaggaaaaccaagctatgacctcggaatccctctctttgaccatctacgagtctacctcgctaaagaagataaatggctggatatccatactaaacaaaaccacaaccattttaactttgtcaaagaatgccgactggacaaaacactcgtatcaactattcaacaccaagacctcttaaaagctgaacaactaactttcaccctcagctggttaccaagtcactaa

SEQ ID NO: 147 - DNA, 948 bp, Streptococcus pneumoniae
atggcaaatcgtaaaattgtagtagctttgggaggaaatgcgattctttcttctgacccatcagcaaaggctcaacaagaagctttagttgaaacagctaagcatcttgtaaaattgattaaaaatggagatgatctgattatcactcacggtaatggacctcaagttgggaatctcttgctccaacatttggcatcagactctgaaaagaaccctgccttcccactcgactcacttgtcgctatgacagaaggtagcatcggtttctggttgaaaaatgctttgcaaaatgctctcttggatgaaggcatcgaaaaaaatgttgcctctgttgtaacgcaagttgtcgtagataaaaatgatccagcttttgttaacttgagtaaaccaatcggtcctttctattcagaagaagaagcaaaagcagaagccgaaaaaagcggagcgactttcaaggaagatgctggccgtggctggcgtaaggtcgttgcctcaccaaaacctgttgacatcaaagaaattgaaaccatccgtactcttttaaataatggtcaagtcgtcgtagctgcaggtggtggcggtattcccgtcgtcaaagaaaacaatggacatttgactggtgtcgaagcggttattgataaagacttcgcttcccaacgtttggcagaattggttgatgcagacctcttcatcgttttgacaggtgtagattatgtatttgttaactacaacaagccaaaccaggaaaaattggaacatgtgaatgttgcccagctggaagaatatatcaaacaagatcagtttgcaccaggtagcatgcttccaaaagtagaagcagctatcgcttttgtcaatggtcgtccagaaggaaaagcagttattacttcccttgaaaatctaggcgccttgattgaatctgaaagcggaacaattattgaaaaaggataa

SEQ ID NO: 148 - DNA, 1428 bp, Streptococcus pneumoniae
atgtatttaggagatttgatggagaaagccgagtgtggtcaattttcaatactttcctttctattacaagagtctcagacgaccgtcaaggctgtaatggaagaaacaggattttcaaaagcaaccctaaccaaatatgtcaccctgctcaatgacaaggctttggatagtggcttagagctggctattcactcagaagatgaaaatctgcgtctgtctatcggtgcagctaccaaggggagagatattcggagcttgtttttggagagtgctgttaaataccagattttggtttatcttctctaccaccaacagtttttagcccatcagctggctcaagaattggtgattagcgaggctacgcttggtcgtcacttggctggtttaaatcagattttgtcagaatttgatttatccatccaaaatggccgttggcgaggtccagagcatcagattcactatttctatttctgtcttttccgaaaggtctggtcgagtcaggaatgggaaggtcacatgcagaaaccagagagaaaacaggagattgccaatttagaggaaatctgcggtgcaagtttgtctgcggggcagaaattggacttggttctctgggctcacatcagtcaacaacgtcttcgggtcaatgcttgtcagtttcaagtcatagaagagaaaatgcgagggtattttgacaatatcttttatcttcgtttgctgagaaaggttccgtccttttttgctgggcaacatattccactaggagttgaggatggtgagatgatgatattcttctcttttctcctatctcatcgcattcttcctcttcatactatggagtatattcttggttttggagggcagttggcagatttactgacgcaattgattcaagaaatgaagaaggaggaactattgggggattatacagaggaccatgtcacctatgaactcagtcagctttgtgctcaagtctatctctataagggctatattttacaggatcgctacaagtaccagttagagaatcgtcatccatatttactgatggaacatgattttaaagagacagcagaggagatttttcatgctctacctgcttttcaacaggggacagatttagataagaagattctctgggaatggctccagttaatcgaatatatggctgaaaacggtggccagcatatgcggattggtctggatttgacatctggttttcttgtcttttcaaggatggcagccattttgaaacggtatttggaatacaatcgttttattaccattgaagcttatgaccctagtcggcattatgatttgctggttaccaataacccgattcataagaaggaacagacaccagtctattatttaaaaaatgacttggatatggaggatttggtagcgattcgccagttattattcacttaa

SEQ ID NO: 149 - DNA, 1332 bp, Streptococcus pneumoniae
atgataaaaaatcctaaattattaaccaagtcttttttaagaagttttgcaattctaggtggtgttggtctagtcattcatatagctatttatttgacctttcctttttattatattcaactggagggggaaaagtttaatgagagcgcaagagtgtttacggagtatttaaagactaagacatctgatgaaattccaagcttactccagtcttattcaaagtccttgaccatatctgctcaccttaaaagagatattgtagataagcggctccctcttgtgcatgacttggatattaaagatggaaagctatcaaattatatcgtgatgttagatatgtctgttagtacagcagatggtaaacaggtaaccgtgcaatttgttcacggggtggatgtctacaaagaagcaaagaatattttgcttttgtatctcccatatacatttttggttacaattgctttttcctttgttttttcttatttttatactaaacgcttgctcaatcctcttttttacatttcagaagtgactagtaaaatgcaagatttggatgacaatattcgttttgatgaaagtaggaaagatgaagttggtgaagttggaaaacagattaatggtatgtatgagcacttgttgaaggttatttatgagttggaaagtcgtaatgagcaaattgtaaaattgcaaaatcaaaaggtttcctttgtccgcggagcatcacatgagttgaaaacccctttagccagtcttagaattatcctagagaatatgcagcataatattggagattacaaagatcatccaaaatatattgcaaagagtataaataagattgaccagatgagccacttattagaagaagtactggagtcttctaaattccaagagtggacagagtgtcgtgagaccttgactgttaagccagttttagtagatattttatcacgttatcaagaattagctcattcaataggtgttacaattgaaaatcaattgacagatgctaccagggtcgtcatgagtcttagggcattggataaggttttgacaaacctgattagtaatgcaattaaatattcagataaaaatgggcgtgtaatcatatccgagcaagatggctatctctctatcaaaaatacatgtgcgcctctaagtgaccaagaactagaacatttatttgatatattctatcattctcaaatcgtgacagataaggatgaaagttccggtttgggtctttacattgtgaataatattttagaaagctatcaaatggattatagttttctcccttatgaacacggtatggaatttaagattagcttgtag

SEQ ID NO: 150 - DNA, 1008 bp, Streptococcus pneumoniae
atgaagaaaacatggaaagtgtttttaacgcttgtaacagctcttgtagctgttgtgcttgtggcctgtggtcaaggaactgcttctaaagacaacaaagaggcagaacttaagaaggttgactttatcctagactggacaccaaataccaaccacacagggctttatgttgccaaggaaaaaggttatttcaaagaagctggagtggatgttgatttgaaattgccaccagaagaaagttcttctgacttggttatcaacggaaaggcaccatttgcagtgtatttccaagactacatggctaagaaattggaaaaaggagcaggaatcactgccgttgcagctattgttgaacacaatacatcaggaatcatctctcgtaaatctgataatgtaagcagtccaaaagacttggttggtaagaaatatgggacatggaatgacccaactgaacttgctatgttgaaaaccttggtagaatctcaaggtggagactttgagaaggttgaaaaagtaccaaataacgactcaaactcaatcacaccgattgccaatggcgtctttgatactgcttggatttactacggttgggatggtatccttgctaaatctcaaggtgtagatgctaacttcatgtacttgaaagactatgtcaaggagtttgactactattcaccagttatcatcgcaaacaacgactatctgaaagataacaaagaagaagctcgcaaagtcatccaagccatcaaaaaaggctaccaatatgccatggaacatccagaagaagctgcagatattctcatcaagaatgcacctgaactcaaggaaaaacgtgactttgtcatcgaatctcaaaaatacttgtcaaaagaatacgcaagcgacaaggaaaaatggggtcaatttgacgcagctcgctggaatgctttctacaaatgggataaagaaaatggtatccttaaagaagacttgacagacaaaggcttcaccaacgaatttgtgaaataa

SEQ ID NO: 151 - DNA, 663 bp, Streptococcus pneumoniae
atgaagtgcttgttatgtgggcagactatgaagactgttttaacttttagtagtctcttacttctgaggaatgatgactcttgtctttgttcagactgtgattctacttttgaaagaattggggaagagaactgtccaaattgtatgaaaacagagttgtcaacaaagtgtcaagattgtcaactttggtgtaaagagggagttgaagtcagtcatagagcgatttttacttacaatcaagctatgaaggattttttcagtcggtataagtttgatggagacttcctgttaagaaaagttttcgcttcatttttaagtgaggagttgaaaaagtacaaagagtatcaatttgttgtaattcccctaagtcctgatagatatgctaatagaggatttaatcaggttgagggcttggtagaggcagcaggctttgagtatctggatttattagagaaaagagaagagagagccagttcttctaaaaatcgttcagagcgcttggggacagaacttcctttctttattaaaagtggagtcactattcctaaaaaaatcctacttatagatgatatctatactacaggagcaactataaatcgtgttaagaaactgttggaagaagctggtgctaaggatgtaaaaacattttcccttgtaagatga

SEQ ID NO: 152 - DNA, 819 bp, Streptococcus pneumoniae
atgaaccgttttaaaaaatcaaaatatgtcattattgtttttgtcactgttctgcttgtgtcagctctcttagcgacgacttattcaagtacaattgtgacaaaattaggagatggaatctcattggttgatagagttgtacaaaaaccttttcagtggtttgattctgtcaaatcagatttggctcatttgacacgaacatataatgaaaatgaaagtttgaagaaacagctttaccaattagaagttaaatcaaatgaggtggaaagtttaaagacagaaaatgaacaactgcgccaattgcttgatatgaagtctaaattgcaagccacaaagactttagcagcagatgttattatgcgttctccggtatcttggaagcaggagttgaccttagatgcaggtagatcaaaaggtgcttctgagaacatgttagctattgcaaatggtggcttgattgggagtgtttcaaaagtagaggagaactctactatagtcaaccttctgacaaatacggaaaatgctgataagatttctgttaaaattcaacatggctctactacaatttatggaattattattggctatgacaaggaaaatgacgttcttaaaattagccaattaaatagtaatagcgatattagtgcgggagataaggtgactactggtggattaggaaactttaacgttgctgatattcctgttggtgaagtggttgccacaacgcatagtacagactatttgacacgagaagtaactgttaaattgagtgcagatactcataatgtagatgtgatagaattagtggggaattcataa

SEQ ID NO: 153 - protein, 400 aa, Streptococcus pneumoniae
EKEVVYTSKEIYYLSQSDFGIYFREKLSSPMVYGEVPVYANEDLVVESGKLTPKTSFQITEWRLNKQGIPVFKLSNHQFIAADKRFLYDQSEVTPTIKKVWLESDFKLYNSPYDLKEVKSSLSAYSQVSIDKTMFVEGREFLHIDQAGWVAKESTSEEDNRMSKVQEMLSEKYQKDSFSIYVKQLTTGKEAGINQDEKMYAASVLKLSYLYYTQEKINEGLYQLDTTVKYVSAVNDFPGSYKPEGSGSLPKKEDNKEYSLKDLITKVSKESDNVAHNLLGYYISNQSDATFKSKMSAIMGDDWDPKEKLISSKMAGKFMEAIYNQNGFVLESLTKTDFDSQRIAKGVSVKVAHKIGDADEFKHDTGVVYADSPFILSIFTKNSDYDTISKIAKDVYEVLK

SEQ ID NO: 154 - protein, 408 aa, Streptococcus pneumoniae
EKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKVTASEDGVLHLNPETSDSSMVAEGALLAQLYPSLEREGKAKLTAYLSSKYVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 155 - protein, 198 aa, Streptococcus pneumoniae
KQDMNIIAIDDHAERINQFEPVLARGVIGDITDEELLRSAGIDTCDTVVVATGENLESSVLAVMHCKSLGVPTVIAKVKSQTAKKVLEKIGADSVISPEYEMGQSLAQTILFHNSVDVFQLDKNVSIVEMKIPQSWAGQSLSKLDLRGKYNLNILGFREQENSPLDVEFGPDDLLKADTYILAVINNQYLDTLVALNS

SEQ ID NO: 156 - protein, 241 aa, Streptococcus pneumoniae
FDSLEESEREKGLMIAQLSHDIKTPITSIQATVEGILDGIIKESEQAHYLATIGRQTERLNKLVEELNFLTLNTARNQVETTSKDSIFLDKLLIECMSEFQFLIEQERRDVHLQVIPESARIEGDYAKLSRILVNLVDNAFKYSAPGTKLEVVAKLEKDQLSISVTDEGQGIAPEDLENIFKRLYRVETSRNMKTGGHGLGLAIARELAHQLGGEITVSSQYGLGSTFTLVLNLSGSENKA

SEQ ID NO: 157 - protein, 462 aa, Streptococcus pneumoniae
NSKKAADSGDKPVIKMYQIGDKPDNLDELLANANKIIEEKVGAKLDIQYLGWGDYGKKMSVITSSGENYDIAFADNYIVNAQKGAYADLTELYKKEGKDLYKALDPAYIKGNTVNGKIYAVPVAANVASSQNFAFNGTLLAKYGIDISGVTSYETLEPVLKQIKEKAPDVVPFAIGKVFIPSDNFDYPVANGLPFVIDLEGDTTKVVNRYEVPRFKEHLKTLHKFYEAGYIPKDVATSDTSFDLQQDTWFVREETVGPADYGNSLLSRVANKDIQIKPITNFIKKNQTTQVANFVISNNSKNKEKSMEILNLLNTNPELLNGLVYGPEGKNWEKIEGKENRVRVLDGYKGNTHMGGWNTGNNWILYINENVTDQQIENSKKELAEAKESPALGFIFNTDNVKSEISAIANTMQQFDTAINTGTVDPDKAIPELMEKLKSEGAYEKVLNEMQKQYDEFLKNKK

SEQ ID NO: 158 - protein, 274 aa, Streptococcus pneumoniae
DGIKSLLSMSKEPVYDSRTEKLTFGKEVENLEITLHQHTLTITDSFDDQIHISYHPSLSAHHDLITNQNDRTLSLTDKKLSETPFLSSGIGGILHIASSYSSRFEEVILRLPKGRTLKGINISANRGQTTIINASLENATLNTNSYILRIEGSRIKNSKLTTPNIVNIFDTVLTDSQLESTENHFHAENIQVHGKVELTAKDYLRIILDQKESQRINWDISSNYGSIFQFTREKPESRGTELSNPYKTEKTDVKDQLIARSDDNIDLISTPSRR

SEQ ID NO: 159 - protein, 195 aa, Streptococcus pneumoniae
VRIGKIVSSIFDDTPTEVEFQLFNSFAKTYRGHGTDLALVAGILGMDTDDPEIPNSLEIAHKRGIKIVWTIQKDSNAPHPNTTKITVKNAHKTISVTGISIGGGNIQVTELNGFAVSLNMNTPTIIIVHQDIPGMIALVTEALSRYGINIAQMNVTREKAGEKAIMIIEVDSRNCDEAIEEIRKIPHLHNVNFFK

SEQ ID NO: 160 - protein, 166 aa, Streptococcus pneumoniae
QESSTYTVKEGDTLSEIAETHNTTVEKLAENNHIDNIHLIYVDQELVIDGPVAPVATPAPATYAAPAAQDETVSAPVAETPVVSETVVSTVSGSEAEAKEWIAQKESGGSYTATNGRYIGRYQLTDSYLNGDYSAENQERVADAYVAGRYGSWTAAKNFWLNNGWY

SEQ ID NO: 161 - protein, 202 aa, Streptococcus pneumoniae
ETTINIKKNHSITLMPAIDFLMASLDWTPKDLDRIVVAEGPGSYTGLRIAVATAKTLAHTLNIELVGMSSLLALVPHQQEGLFVPLMDARRNNVYAGFYENAKPVMAEAHLSFEEVLEKVKGTSQVTFVGEVGPFVEQIQKHLPRTDYKETLPNAANLALLAWDKEADSLHDFVPNYLKRVEAEENWLKNHTESGESYIKRL

SEQ ID NO: 162 - protein, 260 aa, Streptococcus pneumoniae
NSEKKADNATTIKIATVNRSGSEEKRWDKIQELVKKDGITLEFTEFTDYSQPNKATADGEVDLNAFQHYNFLNNWNKENGKDLVAIADTYISPIRLYSGLNGSANKYTKVEDIPANGEIAVPNDATNESRALYLLQSAGLIKLDVSGTALATVANIKENPKNLKITELDASQTARSLSSVDAAVVNNTFVTEAKLDYKKSLFKEQADENSKQWYNIIVAKKDWETSPKADAIKKVIAAYHTDDVKKVIEESSDGLDQPVW

SEQ ID NO: 163 - protein, 164 aa, Streptococcus pneumoniae
PATKTEKDTLQSALPVIENAEKNTVVTKTLVLPKSDDGSQQTQTITYKDKTFLSLAIQQKRPVSDELKTYIDQHGVEETQKALLEAEEKDKSIIEARKLAGFKLETKLLSATELQTTTSFDFQVLDVKKASQLEHLKNIGLENLLKNEPSKYISDRLANGATEQ

SEQ ID NO: 164 - protein, 108 aa, Streptococcus pneumoniae
NTNTANAGGNQNQAAPVQNQPVAQPTDIDGTYTGQDDGDRITLVVTGTTGTWTELESDGDQKVKQVTLDSANQRMIIGDDVKIYTVNGNQIVVDDMDRDPSDQIVLTK

SEQ ID NO: 165 - protein, 77 aa, Streptococcus pneumoniae
QSSGVEAEIEAFSQSKLADYAPNIDVALLGPQVAYTLDKSKEICDKCDVPIAVIPMMDYGMLDGKKVLDLALSLISG

SEQ ID NO: 166 - protein, 384 aa, Streptococcus pneumoniae
GLTNRLNATSNYSEYSISVAVLADSEIENVTQLTSVTAPTGTNNENIQKLLADIKSSQNTDLTVNQSSSYLAAYKSLIAGETKAIVLNSVFENIIESEYPDYASKIKKIYTKGFTKKVEAPKTSKSQSFNIYVSGIDTYGPISSVSRSDVNILMTVNRDTKKILLTTTPRDAYVPIADGGNNQKDKLTHAGIYGVDSSIHTLENLYGVDINYYVRLNFTSFLKLIDLLGGIDVYNDQEFTAHTNGKYYPAGNVHLDSEQALGFVRERYSLADGDRDRGRHQQKVIVAILQKLTSTEVLKNYSTIINSLQDSIQTNMPLETMINLVNAQLESGGNYKVNSQDLKGTGRMDLPSYAMPDSNLYVMEIDDSSLAVVKAAIQDVMEGR

SEQ ID NO: 167 - protein, 176 aa, Streptococcus pneumoniae
WSNVRVEGHSMDPTLADGEILFVVKHLPIDRFDIVVAHEEDGNKDIVKRVIGMPGDTIRYENDKLYINDKETDEPYLADYIKRFKDDKLQSTYSGKGFEGNKGTFFRSIAQKAQAFTVDVNYNTNFSFTVPEGEYLLLGDDRLVSSDSRHVGTFKAKDITGEAKFRLWPITRIGTF

SEQ ID NO: 168 - protein, 274 aa, Streptococcus pneumoniae
DEYLRIGMEAAYAPFNWTQDDDSNGAVKIDGTNQYANGYDVQIAKKIAKDLGKEPLVVKTKWEGLVPALTSGKIDMIIAGMSPTAERKQEIAFSSSYYTSEPVLLVKKDSAYASAKSLDDFNGAKITSQQGVYLYNLIAQIPGAKKETAMGDFAQMRQALEAGVIDAYVSERPEALTAEAANSKFKMIQVEPGFKTGEEDTAIAIGLRKNDNRISQINASIETISKDDQVALMDRMIKEQPAEATTTEETSSSFFSQVAKILSENWQQLLRGAG

SEQ ID NO: 169 - protein, 111 aa, Streptococcus pneumoniae
FSSTVTKVVDETKKVVKRAEQSASAAGKAVSKKVEQAVEATKEQAQKVANSVEDFAANLGGLPLDRAKTFYDEGIKSASDFKNWTEKELLALKGIGPATIKKLKENGIKFK

SEQ ID NO: 170 - protein, 242 aa, Streptococcus pneumoniae
DKTLSSASNKTKTLKLVTWNVANQIEAQHIERIFSHFDADMAIFPELATNIRGEQENQRIKLLFHQVGLSMANYDIFTSPPTNSGIAPVTVIVKKSYGFYTEAKTFHTTRFGTIVLHSRKQNIPDIIALHTAPPLPGLMEIWKQDLNIIHNQLASKYPKAIIAGDFNATMRHGALAKISSHRDALNALPPFERGTWNSQSPKLFNATIDHILLPKNHYYVKDLDIVSFQNSDHRCIFTEITF

SEQ ID NO: 171 - protein, 170 aa, Streptococcus pneumoniae
AHRLSHFLWKHGFKLLARMYSQFWRFWTQIEIHPGAQIDSGVFIDHGSGLVIGETAIVEKGVLLYHGVTLGGTGKDCGKRHPTVRKGALISAHAQVIGPVEIGENAKVGAAAVVVADVPSDVTVVGIPAKIVRLHGKKDEPVIHEVEEKREYYVNKLEQAKDASHRSSGL

SEQ ID NO: 172 - protein, 262 aa, Streptococcus pneumoniae
IKGATAKASQETFKNITNSFSMQINRRVNQGTPRGAGNIKGEDIKKITENKAIESYVKRINAIGDLTGYDLIETPETKKNLTADRAKRFGSSLMITGVNDSSKEDKFVSGSYKLVEGEHLTNDDKDKILLHKDLAAKHGWKVGDKVKLDSNIYDADNEKGAKETVEVTIKGLFDGHNKSAVTYSQELYENTAITDIHTAAKLYGYTEDTAIYGDATFFVTADKNLDDVMKELNGISGINWKSYTLVKSSSNYPALEQSISGM

SEQ ID NO: 173 - protein, 220 aa, Streptococcus pneumoniae
EAILQLEKMKVEFLRGASHELKTPLASLKILIENMRENIGRYKDRDQYLGVALGIVDELNHHVLQILSLSSVQELRDDRETIDLLQMTQNLVKDYALLAKERELQIDNSLTHQQAYLNPSVMKLILSNLISNAIKHSVPGGLVRIGEREGELFIENSCSSEEQEKLAQSFSDNASRKVKGSGMGLFVVKSLLEHEKLAYRFEMEENSLTFFIDFPKVVQD

SEQ ID NO: 174 - protein, 193 aa, Streptococcus pneumoniae
NGDFQGALKQAERSVKIGQQSIDQWEKTGQLPKLSQTDSHQHSEGRWAQASARIYLDPQMDSRFQEAYLEAIQNWNQTGAFNFELVTESSKADITATEMNDGGTPVAGEAESQTNLLTGQFLSVTVRLNHYYLSNPYYGYSYERLVHTAEHELGHAIGLDHTDEKSVMQPAGSFYGIQEEDVANLRKIYETSE

SEQ ID NO: 175 - protein, 240 aa, Streptococcus pneumoniae
SAQKTIVLATAGDVPPFDYEDKGNLTGFDIEVLKAVDEKLSDYEIQFQRTAWESIFPGLDSGHYQAAANNLSYTKERAEKYLYSLPISNNPLVLVSNKKNPLTSLDQIAGKTTQEDTGTSNAQFINNWNQKHTDNPATINFSGEDIGKRILDLANGEFDFLVFDKVSVQKIIKDRGLDLSVVDLPSADSPSNYIIFSSDQKEFKEQFDKALKELYQDGTLEKLSNTYLGGSYLPDQSQLQ

SEQ ID NO: 176 - protein, 218 aa, Streptococcus pneumoniae
QEKTKNEDGETKTEQTAKADGTVGSKSQGAAQKKAEVVNKGDYYSIQGKYDEIIVANKHYPLSKDYNPGENPTAKAELVKLIKAMQEAGFPISDHYSGFRSYETQTKLYQDYVNQDGKAAADRYSARPGYSEHQTGLAFDVIGTDGDLVTEEKAAQWLLDHAADYGFVVRYLKGKEKETGYMAEEWHLRYVGKEAKEIAASGLSLEEYYGFEGGDYVD

SEQ ID NO: 177 - protein, 817 aa, Streptococcus pneumoniae
ESVVYADETLITHTAEKPKEEKMIVEEKADKALETKNIVERTEQSEPSSTEAIASEKKEDEAVTPKEEKVSAKPEEKAPRIESQASNQEKPLKEDAKAVTNEEVNQMIEDRKVDFNQNWYFKLNANSKEAIKPDADVSTWKKLDLPYDWSIFNDFDHESPAQNEGGQLNGGEAWYRKTFKLDEKDLKKNVRLTFDGVYMDSQVYVNGQLVGHYPNGYNQFSYDITKYLQKDGRENVIAVHAVNKQPSSRWYSGSGIYRDVTLQVTDKVHVEKNGTTILTPKLEEQQHGKVETHVTSKIVNTDDKDHELVAEYQIVERGGHAVTGLVRTASRTLKAHESTSLDAILEVERPKLWTVLNDKPALYELITRVYRDGQLVDAKKDLFGYRYYHWTPNEGFSLNGERIKFHGVSLHHDHGALGAEENYKAEYRRLKQMKEMGVNSIRTTHNPASEQTLQIAAELGLLVQEEAFDTWYGGKKPYDYGRFFEKDATHPEARKGEKWSDFDLRTMVERGKNNPAIFMWSIGNEIGEANGDAHSLATVKRLVKVIKDVDKTRYVTMGADKFRFGNGSGGHEKIADELDAVGFNYSEDNYKALRAKHPKWLIYGSETSSATRTRGSYYRPERELKHSNGPERNYEQSDYGNDRVGWGKTATASWTFDRDNAGYAGQFIWTGTDYIGEPTPWHNQNQTPVKSSYFGIVDTAGIPKHDFYLYQSQWVSVKKKPMVHLLPHWNWENKELASKVADSEGKIPVRAYSNASSVELFLNGKSLGLKTFNKKQTSDGRTYQEGANANELYLEWKVAYQPGTLEAIARDESGKEI

SEQ ID NO: 178 - protein, 900 aa, Streptococcus pneumoniae
ARDKITTAGKPAAVRLIKEDHAIAADGKDLTYIYYEIVDSQGNVVPTANNLVRFQLHGQGQLVGVDNGEQASRERYKAQADGSWIRKAFNGKGVAIVKSTEQAGKFTLTAHSDLLKSNQVTVFTGKKEGQEKTVLGTEVPKVQTIIGEAPEMPTTVPFVYSDGSRAERPVTWSSVDVSKPGIVTVKGMADGREVEARVEVIALKSELPVVKRIAPNTDLNSVDKSVSYVLIDGSVEEYEVDKWEIAEEDKAKLAIPGSRIQATGYLEGQPIHATLVVEEGNPAAPAVPTVTVGGEAVTGLTSQKPMQYRTLAYGAKLPEVTASAKNAAVTVLQASAANGMRASIFIQPKDGGPLQTYAIQFLEEAPKIAHLSLQVEKADSLKEDQTVKLSVRAHYQDGTQAVLPADKVTFSTSGEGEVAIRKGMLELHKPGAVTLNAEYEGAKDQVELTIQANTEKKIAQSIRPVNVVTDLHQEPSLPATVTVEYDKGFPKTHKVTWQAIPKEKLDSYQTFEVLGKVEGIDLEARAKVSVEGIVSVEEVSVTTPIAEAPQLPESVRTYDSNGHVSSAKVAWDAIRPEQYAKEGVFTVNGRLEGTQLTTKLHVRVSAQTEQGANISDQWTGSELPLAFASDSNPSDPVSNVNDKLISYNNQPANRWTNWNRTNPEASVGVLFGDSGILSKRSVDNLSVGFHEDHGVGVPKSYVIEYYVGKTVPTAPKNPSFVGNEDHVFNDSANWKPVTNLKAPAQLKAGEMNHFSFDKVETYAVRIRMVKADNKRGTSITEVQIFAKQVAAAKQGQTRIQVDGKDLANFNPDLTDYYLESVDGKVPAVTASVSNNGLATVVPSVREGEPVRVIAKAENGDILGEYRLHFTKDKSLLSHKPVAAVKQARLLQVGQALELPT

SEQ ID NO: 179 - protein, 477 aa, Streptococcus pneumoniae
KVPVYFTGKDGYETKDLTVEWEEVPAENLTKAGQFTVRGRVLGSNLVAEITVRVTDKLGETLSDNPNYDENSNQAFASATNDIDKNSHDRVDYLNDGDHSENRRWTNWSPTPSSNPEVSAGVIFRENGKIVERTVTQGKVQFFADSGTDAPSKLVLERYVGPEFEVPTYYSNYQAYDADHPFNNPENWEAVPYRADKDIAAGDEINVTFKAIKAKAMRWRMERKADKSGVAMIEMTFLAPSELPQESTQSKILVDGKELADFAENRQDYQITYKGQRPKVSVEENNQVASTVVDSGEDSFPVLVRLVSESGKQVKEYRIHLTKEKPVSEKTVAAVQEDLPKIEFVEKDLAYKTVEKKDSTLYLGETRVEQEGKVGKERIFTAINPDGSKEEKLREVVEVPTDRIVLVGTKPVAQEAKKPQVSEKADTKPIDSSEASQTNKAQLPSTGSAASQAAVAAGLTLLGLSAGLVVTKGKKED

SEQ ID NO: 180 - protein, 161 aa, Streptococcus pneumoniae
EHQTKDEMKTEQTASKTSAAKGKEVADFELMGVDGKTYRLSDYKGKKVYLKFWASWCSICLASLPDTDEIAKEAGDDYVVLTVVSPGHKGEQSEADFKNWYKGLDYKNLPVLVDPSGKLLETYGVRSYPTQAFIDKEGKLVKTHPGFMEKDAILQTLKELA

SEQ ID NO: 181 - protein, 248 aa, Streptococcus pneumoniae
YYQSSSSAIEATIEGNSQTTISQTSHFIQSYIKKLETTSTGLTQQTDVLAYAENPSQDKVEGIRDLFLTILKSDKDLKTVVLVTKSGQVISTDDSVQMKTSSDMMAEDWYQKAIHQGAMPVLTPARKSDSQWVISVTQELVDAKGANLGVLRLDISYETLEAYLNQLQLGQQGFAFIINENHEFVYHPQHTVYSSSSKMEAMKPYIDTGQGYTPGHKSYVSQEKIAGTDWTVLGVSSLEKLDQVRSQL

SEQ ID NO: 182 - protein, 264 aa, Streptococcus pneumoniae
KRWIAPLKDLRETMLEIASGAQNLRAKEVGAYELREVTRQFNAMLDQIDQLMVAIRSQEETTRQYQLQALSSQINPHFLYNTLDTIIWMAEFHDSQRVVQVTKSLATYFRLALNQGKDLICLSDEINHVRQYLFIQKQRYGDKLEYEINENVAFDNLVLPKLVLQPLVENALYHGIKEKEGQGHIKLSVQKQDSGLVIRIEDDGVGFQDAGDSSQSQLKRGGVGLQNVDQRLKLHFGANYHMKIDSRPQKGTKVEIYINRIETS

SEQ ID NO: 183 - protein, 608 aa, Streptococcus pneumoniae
TLALASREGVVEMEGYRYVGYLSGDILKTLGLDTVLEETSAKPGEVTVVEVETPQSITNQEQARTENQVVETEEAPKEEAPKTEESPKEEPKSEVKPTDDTLPKVEEGKEDSAEPAPVEEVGGEVESKPEEKVAVKPESQPSDKPAEESKVEQAGEPVAPREDEKAPVEPEKQPEAPEEEKAVEETPKQEESTPDTKAEETVEPKEETVNQSIEQPKVETPAVEKQTEPTEEPKVEQAGEPVAPREDEQAPTAPVEPEKQPEVPEEEKAVEETPKPEDKIKGIGTKEPVDKSELNNQIDKASSVSPTDYSTASYNALGPVLETAKGVYASEPVKQPEVNSETNKLKTAIDALNVDKTELNNTIADAKTKVKEHYSDRSWQNLQTEVTKAEKVAANTDAKQSEVNEAVEKLTATIEKLVELSEKPILTLTSTDKKILEREAVAKYTLENQNKTKIKSITAELKKGEEVINTVVLTDDKVTTETISAAFKNLEYYKEYTLSTTMIYDRGNGEETETLENQNIQLDLKKVELKNIKRTDLIKYENGKETNESLITTIPDDKSNYYLKITSNNQKTTLLAVKNIEETTVNGTPVYKVTAIADNLVSRTADNK

SEQ ID NO: 184 - protein, 570 aa, Streptococcus pneumoniae
FEEEYVHYIEKPKVHEDNVYYNFKELVEAIQNDPSKEYRLGQSMSARNVVPNGKSYITKEFTGKLLSSEGKQFAITELEHPLFNVITNATINNVNFENVEIERSGQDNIASLANTMKGSSVITNVKITGTLSGRNNVAGFVNNMNDGTRIENVAFFGKLHSTSGNGSHTGGIAGTNYRGIVRKAYVDATITGNKTRASLLVPKVDYGLTLDHLIGTKALLTESVVKGKIDVSNPVEVGAIASKTWPVGTVSNSVSYAKIIRGEELFGSNDVDDSDYASAHIKDLYAVEGYSSGNRSFRKSKTFTKLTKEQADAKVTTFNITADKLESDLSPLAKLNEEKAYSSIQDYNAEYNQAYKNLEKLIPFYNKDYIVYQGNKLNKEHHLNTKEVLSVTAMNNNEFITNLDEANKIIVHYADGTKDYFNLSSSSEGLSNVKEYTITDLGIKYTPNIVQKDNTTLVNDIKSILESVELQSQTMYQHLNRLGDYRVNAIKDLYLEESFTDVKENLTNLITKLVQNEEHQLNDSPAARQMIRDKVEKNKAALLLGLTYLNRYYGVKFGDVNIKELMLFKP

SEQ ID NO: 185 - protein, 601 aa, Streptococcus pneumoniae
DFYGEKVSVLDRLIEIGSKENNIKGSRTFDAFGQVLAKYTKSGNLDAFLNYNRQLFTNIDNMNDWFIDATEDHVYIAERASEVEEIKNSKHRAFDNLKRSHLRNTILPLLNIDKAHLYLISNYNAIAFGSAERLGKKSLEDIKDIVNKAADGYRNYYDFWYRLASDNVKQRLLRDAVIPIWEGYNAPGGWVEKYGRYNTDKVYTPLREFFGPMDKYYNYNGTGAYAAIYPNSDDIRTDVKYVHLEMVGEYGISVYTHETTHVNDRAIYLGGFGHREGTDAEAYAQGMLQTPVTGSGFDEFGSLGINMVFKRKNDGNQWYITDPKTLKTREDINRYMKGYNDTLTLLDEIEAESVISQQNKDLNSAWFKKIDREYRDNNKLNQWDKIRNLSQEEKNELNIQSVNDLVDQQLMTNRNPGNGIYKPEAISYNDQSPYVGVRMMTGIYGGNTSKGAPGAVSFKHNAFRLWGYYGYENGFLGYASNKYKQQSKTDGESVLSDEYIIKKISNNTFNTIEEFKKAYFKEVKDKATKGLTTFEVNGSSVSSYDDLLTLFKEAVKKDAETLKQEANGNKTVSMNNTVKLKEAVYKKLLQQTNSFKTSIFK

SEQ ID NO: 186 - protein, 104 aa, Streptococcus pneumoniae
RIRRAAKIVDNEEFEALIRTGQLIDLRDPAEFHRKHILGARNIPSSQLKTSLAALRKDKPVLLYENQRAQRVTNAALYLKKQGFSEIYILSYGLDSWKGKVKTS

SEQ ID NO: 187 - protein, 225 aa, Streptococcus pneumoniae
DDSREVLDFTKQSQALFINLGHLSAEKEKAIRMAASYANQSSLPMVVDAVGVTTSSIRKSLVKDLLDYRPTVLKGNMSEIRSLVGLKHHGVGVDASAKDQETEDLLQVLKDWCQTYPGMSFLVTGPKDLVVSKNQVAVLGNGCTELDWITGTGDLVGALTAVFLSQGKTGFEASCLAVSYLNIAAEKIVVQGMGLEEFRYQVLNQLSLLRRDENWLDTIKGEVYE

SEQ ID NO: 188 - protein, 247 aa, Streptococcus pneumoniae
ADQVFVDDASLDIDQMMETMYATAEASKSACPSPDDYLRAFEGAKNIFLVTITGTLSGSHNSAQLAKNIYLEDHPDTKIHVIDSLSAGGEVDLLVEKLNDLIDQGLSFEEVVEAITAYQEKTKLLFVLAKVDNLVKNGRLSKLIGTVVGLLNIRMVGKASETGTLELLQKARGSKKSVQAAYDELVKAGYAGGRIVMAQRNNEKCCQQLSERIRETFPQADIKILPTSGLCSFYAEEGGLLMGYEID

SEQ ID NO: 189 - protein, 136 aa, Streptococcus pneumoniae
IFNTAKLATDIENNVRVVVYIRKDVEDNSQTIEKEGQTVTNNDYHKVYDSLKNMSTVKSVTFSSKEEQYEKLTEIMGDNWKIFEGDANPLYDAYIVEANTPNDVKTIAEDAKKIEGVSEVQDGGANTERLFKLASF

SEQ ID NO: 190 - protein, 367 aa, Streptococcus pneumoniae
FRQPSQTALKDEPTHLVVAKEGSVASSVLLSGTVTAKNEQYVYFDASKGDLDEILVSVGDKVSEGQALVKYSSSEAQAAYDSASRAVARADRHINELNQARNEAASAPAPQLPAPVGGEDATVQSPTPVAGNSVASIDAQLGDARDARADAAAQLSKAQSQLDATTVLSTLEGTVVEVNSNVSKSPTGASQVMVHIVSNENLQVKGELSEYNLANLSVGQEVSFTSKVYPDKKWTGKLSYISDYPKNNGEAASPAAGNNTGSKYPYTIDVTGEVGDLKQGFSVNIEVKSKTKAILVPVSSLVMDDSKNYVWIVDEQQKAKKVEVSLGNADAENQEITSGLTNGAKVISNPTSSLEEGKEVKADEATN

SEQ ID NO: 191 - protein, 248 aa, Streptococcus pneumoniae
SRQVNKDMTKSQKNISVFFSPKKSKDGSFTQKQSAFTVSGKEEEVPVEPPKPQESWVQEAAKLKGVDSYYVTNSTNAILTYQDKKVENANLTGGNRTYMDAVKNEIIAGRSLREQDFKEFASVILLDEELSISLFESPQEAINKVVEVNGFSYRVIGVYTSPEAKRSKIYGFGGLPITTNISLAANFNVDEIANIVFRVNDTSLTPTLGPELARKMTELAGLQQGEYQVADESVVFAEIQQSFSFMTT

SEQ ID NO: 192 - protein, 384 aa, Streptococcus pneumoniae
KHAIAVEANTGKILYEKDATQPVEIASITKLITVYLVYEALENGSITLSTPVDISDYPYQLTTNSEASNIPMEARNYTVEELLEATLVSSANSAAIALAEKIAGSEKDFVDMMRAKLLEWGIQDATVVNTTGLNNETLGDNIYPGSKKDEENKLSAYDVAIVARNLIKKYPQVLEITKKPSSTFAGMTITSTNYMLEGMPAYRGGFDGLKTGTTDKAGESFVGTTVEKGMRVITVVLNADHQDNNPYARFTATSSLMDYISSTFTLRKIVQQGDAYQDSKAPVQDGKEDTVTAVAPEDIYLIERVGNQSSQSVQFTPDSKAIPAPLEAGTVVGHLTYEDKDLIGQGYITTERPSFEMVADKKIEKAFFLKVWWNQFVRFVNEKL

SEQ ID NO: 193 - protein, 523 aa, Streptococcus pneumoniae
TEEAVQNLPPIPEEKWVEPEIILPQAELKFPEQEDDSDDEDVQVDFSAKEALEYKLPSLQLFAPDKPKDQSKEKKIVRENIKILEATFASFGIKVTVERAEIGPSVTKYEVKPAVGVRVNRISNLSDDLALALAAKDVRIEAPIPGKSLIGIEVPNSDIATVSFRELWEQSQTKAENFLEIPLGKAVNGTARAFDLSKMPHLLVAGSTGSGKSVAVNGIIASILMKARPDQVKFMMVDPKMVELSVYNDIPHLLIPVVTNPRKASKALQKVVDEMENRYELFAKVGVRNIAGFNAKVEEFNSQSEYKQIPLPFIVVIVDELADLMMVASKEVEDAIIRLGQKARAAGIHMILATQRPSVDVISGLIKANVPSRVAFAVSSGTDSRTILDENGAEKLLGRGDMLFKPIDENHPVRLQGSFISDDDVERIVNFIKTQADADYDESFDPGEVSENEGEFSDGDAGGDPLFEEAKSLVIETQKASASMIQRRLSVGFNRATRLMEELEIAGVIGPAEGTKPRKVLQQ

SEQ ID NO: 194 - protein, 260 aa, Streptococcus pneumoniae
EGTNQRQSSSAKVPWKASYTNLNNQVSTEEVKSLLSAHLDPNSVDAFFNLVNDYNTIVGSTGLSGDFTSFTHTEYDVEKISHLWNQKKGDFVGTNCRINSYCLLKNSVTIPKLEKNDQLLFLDNDAIDKGKVFDSQDKEEFDILFSRVPTESTTDVKVHAEKMEAFFSQFQFNEKARMLSVVLHDNLDGEYLFVGHVGVLVPADDGFLFVEKLTFEEPYQAIKFASKEDCYKYLGTKYADYTGEGLAKPFIMDNDKWVKL

SEQ ID NO: 195 - protein, 284 aa, Streptococcus pneumoniae
GQKESQTGKGMKIVTSFYPIYAMVKEVSGDLNDVRMIQSSSGIHSFEPSANDIAAIYDADVFVYHSHTLESWAGSLDPNLKKSKVKVLEASEGMTLERVPGLEDVEAGDGVDEKTLYDPHTWLDPEKAGEEAQIIADKLSEVDSEHKETYQKNAQAFIKKAQELTKKFQPKFEKATQKTFVTQHTAFSYLAKRFGLNQLGIAGISPEQEPSPRQLTEIQEFVKTYKVKTIFTESNASSKVAETLVKSTGVGLKTLNPLESDPQNDKTYLENLEENMSILAEELK

SEQ ID NO: 196 - protein, 181 aa, Streptococcus pneumoniae
VHQDVKQVMTYQPMVREILSEQDTPANEELVLAMIYTETKGKEGDVMQSSESASGSTNTINDNASSIRQGIQTLTGNLYLAQKKGVDIWTAVQAYNFGPAYIDFIAQNGKENTLALAKQYSRETVAPLLGNRTGKTYSYIHPISIFHGAELYVNGGNYYYSRQVRLNLYIIKCFTLFSTSG

SEQ ID NO: 197 - protein, 320 aa, Streptococcus pneumoniae
SNSVKNEENTSKEHAPDKIVLDHAFGQTILDKKPERVATIAWGNHDVALALGIVPVGFSKANYGVSADKGVLPWTEEKIKELNGKANLFDDLDGLNFEAISNSKPDVILAGYSGITKEDYDTLSKIAPVAAYKSKPWQTLWRDMIKIDSKALGMEKEGDELIKNTEARISKELEKHPEIKGKIKGKKVLFTMINAADTSKFWIYTSKDPRANYLTDLGLVFPESLKEFESEDSFAKEISAEEANKINDADVIITYGDDKTLEALQKDPLLGKINAIKNGAVAVIPDNTPLAASCTPTPLSINYTIEEYLNLLGNACKNAK

SEQ ID NO: 198 - protein, 311 aa, Streptococcus pneumoniae
SSMNKSEAQNNKDEKKITKIGVLQFVSHPSLDLIYKGIQDGLAEEGYKDDQVKIDFMNSEGDQSKVATMSKQLVANGNDLVVGIATPAAQGLASATKDLPVIMAAITDPIGANLVKDLKKPGGNVTGVSDHNPAQQQVELIKALTPNVKTIGALYSSSEDNSKTQVEEFKAYAEKAGLTVETFAVPSTNEIASTVTVMTSKVDAIWVPIDNTIASGFPTVVSSNQSSKKPIYPSATAMVEVGGLASVVIDQHDLGVATGKMIVQVLKGAKPADTPVNVFSTGKSVINKKIAQELGITIPESVLKEAGQVIE

SEQ ID NO: 199 - protein, 539 aa, Streptococcus pneumoniae
ENHLLLNYNTDYELTSGEKLPLPKEISGYTYIGYIKEGKTTSESEVSNQKSSVATPTKQQKVDYNVTPNFVDHPSTVQAIQEQTPVSSTKPTEVQVVEKPFSTELINPRKEEKQSSDSQEQLAEHKNLETKKEEKISPKEKTGVNTLNPQDEVLSGQLNKPELLYREETMETKIDFQEEIQENPDLAEGTVRVKQEGKLGKKVEIVRIFSVNKEEVSREIVSTSTTAPSPRIVEKGTKKTQVIKEQPETGVEHKDVQSGAIVEPAIQPELPEAVVSDKGEPEVQPTLPEAVVTDKGETEVQPESPDTVVSDKGEPEQVAPLPEYKGNIEQVKPETPVEKTKEQGPEKTEEVPVKPTEETPVNPNEGTTEGTSIQEAENPVQPAEESTTNSEKVSPDTSSKNTGEVSSNPSDSTTSVGESNKPEHNDSKNENSEKTVEEVPVNPNEGTVEGTSNQETEKPVQPAEETQTNSGKIANENTGEVSNKPSDSKPPVEESNQPEKNGTATKPENSGNTTSENGQTEPEPSNGNSTEDVSTESNT

SEQ ID NO: 200 - protein, 690 aa, Streptococcus pneumoniae
SNSNGNEEIKQENELDPDKKVEEPEKTLELRNVSDLELYSLSNGTYKQHISLEQVPSNPNSYFVKVKSSSFKDVYLPVASISEERKNDKILYKITAKVEKLQQEIESRYKDNFTFYLAKKGTEETTNFTSFSNLVKAINQNPSGTYHLAASLNANEVELGPDERSYIKDTFTGRLIGEKDGKNYAIYNLKKPLFENLSGATVEKLSLKNVAISGKDDIGSLANEAQNNTKIKQVHVDGVLAGERGIGGLLAKAEQSSITESSFKGRIINTYETTAAYNIGGMVGHLTGDKALLTKSKATVAISSNTNTSDQTVGGLAGLVDRDAQIQDSYAEGDINNVKHFGRVAGVAGNLWDRTSGDVRHAGSLTNVLSDVNVTNGNAITGYHYNEMKVKDTFSSKANRVYNVTLVKDEVVSKESFEERGTMLDASQIASKKAEINPLILPTVEPLSTSGKKDSDFSKVAYYQAKRNLTYKNIEKLLPFYNKATIVKYGNLVNENSLLYQKELLSAVMMKDNQVITDIVSNKQTANKLLLHYKDDLSEKLDLKYQNDFAKLAEYSLGNTGLLYTPNQFLYDQTSIIKQVLPDLQKVDYHSEAIRKTLGISPNVKQTELYLEDQFAKTKQQLEDSLKKLLSADAGLASANPVTEGYLVDKIKRNKEALLLGLTYLERWYNFSYGQVNVKDLVLYHLDFFG

SEQ ID NO: 201 - protein, 621 aa, Streptococcus pneumoniae
KGNASPLDTLIELGKSGFNNLLAKNNVDTYGISLASQHGTTDLFSTLEHYRKVFLPNTSNNDWFKSETKAYIVEEKSTIEEVKTKQGLAGTKYSIGVYDRITSATWKYRNMVLPLLTLPERSVFVISTMSSLGFGAYDRYRSSDHKAGKALNDFVEENARETAKRQRDHYDYWYRILDDNAREKLYRNILLYDAYKFGDDNTVGKATEVADFDNPNPAMQHFFGPVGNKVGHNQHGAYATGDAVYYMGYRMLDKDGAITYTHEMTHDSDQDIYLGGYGRRSGLGPEFFAKGLLQAPDHPDDATITINSILKHSKSDSTESRRLQVLDPTTRFNNADDLKQYVHNMFDVVYMLEYLEGNSILKLDTNQKQQLLRKVTNEYHPDPDGNKVYATNVVRNLTVEEVERLRSFNDLIDNNILSSREYASGKYERNGYFTIKLFAPIYAALSNDIGTPGDLMGRRIAYELLAAKGFKDGMVPYISNQYEEEAKQKGKTINLYGKTRGLVTDDLVLEKVFNNQYHTWSEFKKAMYQERQDQFDRLNKVTFNDTTQPWQTFAKKTTSSVDELQKLMDVAVRKDAEHNYYHWNNYNPDIDSEVHKLKRAIFKAYLDQTNDFRSSIFENKK

SEQ ID NO: 202 - protein, 205 aa, Streptococcus pneumoniae
LVQVNQKPLIEYQIEFLKEKGINDIIIIVGYLKEQFDYLKEKYGVRLVFNDKYADYNNFYSLYLVKEELANSYVIDADNYLFKNMFRNDLTRSTYFSVYREDCTNEWFLVYGDDYKVQDIIVDSKAGRILSGVSFWDAPTAEKIVSFIDKAYVSGEFVDLYWDNMVKDNIKELDVYVEELEGNSIYEIDSVQDYRKLEEILKNEN

SEQ ID NO: 203 - protein, 253 aa, Streptococcus pneumoniae
ATATNGAYVAWEIEASDLVETVANIRRYQMFGINLSMPYKEQVIPYLDKLSDEARLIGAVNTVVNENGNLIGYNTDGKGFFKCLPSFTISGKKMTLLGAGGAAKSILAQAILDGVSQISVFVRSVSMEKTRPYLDKLQEQTGFKVDLCALEYVSELQARIAESDLLVNATSVGMDGQSSPVPENIVLPETLLVADIIYQPFETPFLKWARSQGNPAVNGLGMLLYQAAEAFQLWTGKEMPTEEIWQSLTEKYQ

SEQ ID NO: 204 - protein, 324 aa, Streptococcus pneumoniae
DSQKLVIYNWGDYIDPELLTQFTEETGIQVQYETFDSNEAMYTKIKQGGTTYDIAIPSEYMINKMKDEDLLVPLDYSKIEGIENIGPEFLNQSFDPGNKFSIPYFWGTLGIVYNETMVDEAPEHWDDLWKPEYKNSIMLFDGAREVLGLGLNSLGYSLNSKDLQQLEETVDKLYKLTPNIKAIVADEMKGYMIQNNVAIGVTFSGEASQMLEKNENLRYVVPTEASNLWFDNMVIPKTVKNQNSAYAFINFMLKPENALQNAEYVGYSTPNLPAKELLPEETKEDKAFYPDVETMKHLEVYEKFDHKWTGKYSDLFLQFKMYRK

SEQ ID NO: 205 - protein, 62 aa, Streptococcus pneumoniae
AYEGKVEAKKLLDSYKGFKAVVPSKSEEKRLGREFETVSGYSLYRAVQAAKEKGEGKISLGK

SEQ ID NO: 206 - protein, 115 aa, Streptococcus pneumoniae
WLEKHKVPFVEHNIMTSPLTRKELQHILSLTENGTDDIISTRSKIFQKLNIDVESISVSELLHLIEQYPSLLRRPIIIDAKRMQIGFNEDEIRAFLPRSYRKQELKEARMRAGIS

SEQ ID NO: 207 - protein, 157 aa, Streptococcus pneumoniae
MFQNWASSAENLTYVTWDPHPDVEITRNSICNWVASYTNLNYYKWAICLKENPEQVIGDISIVKIDEADLSCEIGYVLGKAYWGNGMMTETLKAILDFCFTQAGFQKVRARYASLNPASGRVMEKAGMSYLQTIVNGVERKGYLADLIYYGISREEC

SEQ ID NO: 208 - protein, 425 aa, Streptococcus pneumoniae
KIYQQKSFEQKIESLKKEKDDQLSEGNQKEHFRQGQAEVIAYYPLQGEKVISSVRELINQDVKDKLESKDNLVFYYTEQEESGLKGVVNRNVTKQIYDLVAFKIEETEKTSLGKVHLTEDGQPFTLDQLFSDASKAKEQLIKELTSFIEDKKIEQDQSEQIVKNFSDQDLSAWNFDYKDSQIILYPSPVVENLEEIALPVSAFFDVIQSSYLLEKDAALYQSYFDKKHQKVVALTFDDGPNPATTPQVLETLAKYDIKATFFVLGKNVSGNEDLVKRIKSEGHVVGNHSWSHPILSQLSLDEAKKQITDTEDVLTKVLGSSSKLMRPPYGAITDDIRNSLDLSFIMWDVDSLDWKSKNEASILTEIQYQVANGSIVLMHDIHSPTVNALPRVIEYLKNQGYTFVTIPEMLNTRLKAHELYYSRDE

SEQ ID NO: 209 - protein, 252 aa, Streptococcus pneumoniae
TSGDNWSKYQSNKSITIGFDSTFVPMGFAQKDGSYAGFDIDLATAVFEKYGITVNWQPIDWDLKEAELTKGTIDLIWNGYSATDERREKVAFSNSYMKNEQVLVTKKSSGITTAKDMTGKTLGAQAGSSGYADFEANPEILKNIVANKEANQYQTFNEALIDLKNDRIDGLLIDRVYANYYLEAEGVLNDYNVFTVGLETEAFAVGARKEDTNLVKKINEAFSSLYKDGKFQEISQKWFGEDVATKEVKEGQ

SEQ ID NO: 210 - protein, 115 aa, Streptococcus pneumoniae
EGEKLAQQYAGLEQADQVDLYNGLESYYSVLGRNKQQEALAVLIGKDDHKIYVYQLNQGVSQEKAETVSKEKGAGEIDKITFGRYQDKPIWEVKSGSDFYLVDFETGALVNKEGL

SEQ ID NO: 211 - protein, 232 aa, Streptococcus pneumoniae
QNSTSARQVKTETYTNTVTNVPIDIRYNSDKYFISGFASEVSVVLTGANRLSLASEMQESTRKFKVTADLTDAGVGTIEVPLSIEDLPNGLTAVATPQKITVKIGKKAQKDKVKIVPEIDPSQIDSRVQIENVMVSDKEVSITSDQETLDRIDKIIAVLPTSERITGNYSGSVPLQAIDRNGVVLPAVITPFDTIMKVTTKPVAPSSSTSNSSTSSSSETSSSTKATSSKTN

SEQ ID NO: 212 - protein, 217 aa, Streptococcus pneumoniae
MFYTYLRGLVVLLLWSINGNAHYHNTDKIPNQDENYILVAPHRTWWDPVYMAFATKPKQFIFMAKKELFTNRIFGWWIRMCGAFPIDRENPSASAIKYPINVLKKSDRSLIMFPSGSRHSNDVKGGAALIAKMAKVRIMPVTYTGPMTLKGLISRERVDMNFGNPIDISDIKKMNDEGIETVANRIQTEFQRLDEETKQWHNDKKPNPLWWFIRIPA

SEQ ID NO: 213 - protein, 336 aa, Streptococcus pneumoniae
KVTSPNMEATANAYLTTAQTLDLAVMSNYGLDQADQEELKQTEGAEVEFGYLTDVTMDNGQDAIRLYSKPERISTFQLRKGRLPQSDKEIALATHLQGQYSVGQEISFKEKEEGHSSLKDHTYTITGFVDSAEILSQRDMGYAGSGSGTLTAYGVILPSQFDQKVYNIARLKYQDLAGLNAFSSAYEEKSKQHQEELEQILSDNGKVRLQLLKKEGQESLDKGQETLDKAQTNLQEGKRRLAAAQARIQAQESQLALFPQVQREQASAQLTQAKQELGKEEDKLKQAEQNLAQEKEKLEKHQQVLDDLAEPRYQVYNRQTMPGGQGYLMYSNASSS

SEQ ID NO: 214 - protein, 378 aa, Streptococcus pneumoniae
KSIIEAFEKANPDIKVKLETIDFKSGPEKITTAIEAGTAPDVLFDAPGRIIQYGKNGKLAELNDLFTDEFVKDVNNENIVQASKAGDKAYMYPISSAPFYMAMNKKMLEDAGVANLVKEGWTTDDFEKVLKALKDKGYTPGSLFSSGQGGDQGTRAFISNLYSGSVTDEKVSKYTTDDPKFVKGLEKATSWIKDNLINNGSQFDGGADIQNFANGQTSYTILWAPAQNGIQAKLLEASKVEVVEVPFPSDEGKPALEYLVNGFAVFNNKDDKKVAASKKFIQFIADDKEWGPKDVVRTGAFPVRTSFGKLYEDKRMETISGWTQYYSPYYNTIDGFAEMRTLWFPMLQSVSNGDEKPADALKAFTEKANETIKKAMKQ

SEQ ID NO: 215 - protein, 320 aa, Streptococcus pneumoniae
EEKADKSQELVIYSNSVSNGRGDWLTAKAKEAGFNIKMVDIAGAQLADRVIAEKNNAVADMVFGIGAVDSNKIRDQKLLVQYKPKWLDKIDQSLSDKDNYYNPVIVQPLVLIGAPDVKEMPKDWTELGSKYKGKYSISGLQGGTGRAILASILVRYLDDKGELGVSEKGWEVAKEYLKNAYTLQKGESSIVKMLDKEDPIQYGMMWGSGALVGQKEQNVVFKVMTPEIGVPFVTEQTMVLSTSKKQALAKEFIDWFGQSEIQVEYSKNFGSIPANKDALKDLPEDTKKFVDQVKPQNIDWEAVGKHLDEWVEKAELEYVQ

SEQ ID NO: 216 - protein, 282 aa, Streptococcus pneumoniae
TEVTIKSSLDEVKLSKVPEKIVTFDLGAADTIRALGFEKNIVGMPTKTVPTYLKDLVGTVKNVGSMKEPDLEAIAALEPDLIIASPRTQKFVDKFKEIAPTVLFQASKDDYWTSTKANIESLASAFGETGTQKAKEELTKLDKSIQEVATKNESSDKKALAILLNEGKMAAFGAKSRFSFLYQTLKFKPTDTKFEDSRHGQEVSFESVKEINPDILFVINRTLAIGGDNSSNDGVLENALIAETPAAKNGKIIQLTPDLWYLSGGGLESTKLMIEDIQKALK

SEQ ID NO: 217 - protein, 619 aa, Streptococcus pneumoniae
YTADPETLDYLISSKNSTTVVTSNGIDGLFTNDNYGNLAPAVAEDWEVSKDGLTYTYKIRKGVKWFTSDGEEYAEVTAKDFVNGLKHAADKKSEAMYLAENSVKGLADYLSGTSTDFSTVGVKAVDDYTLQYTLNQPEPFWNSKLTYSIFWPLNEEFETSKGSDFAKPTDPTSLLYNGPFLLKGLTAKSSVEFVKNEQYWDKENVHLDTINLAYYDGSDQESLERNFTSGAYSYARLYPTSSNYSKVAEEYKDNIYYTQSGSGIAGLGVNIDRQSYNYTSKTTDSEKVATKKALLNKDFRQALNFALDRSAYSAQINGKDGAALAVRNLFVKPDFVSAGEKTFGDLVAAQLPAYGDEWKGVNLADGQDGLFNADKAKAEFAKAKKALEADGVQFPIHLDVPVDQASKNYISRIQSFKQSVETVLGVENVVVDIQQMTSDEFLNITYYAANASSEDWDVSGGVSWGPDYQDPSTYLDILKTTSSETTKTYLGFDNPNSPSVVQVGLKEYDKLVDEAARETSDLNVRYEKYAAAQAWLTDSSLFIPAMASSGAAPVLSRIVPFTGASAQTGSKGSDVYFKYLKSQDKVVTKEEYEKAREKWLKEKAESNEKAQKELASHVK

SEQ ID NO: 218 - protein, 390 aa, Streptococcus pneumoniae
ADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 219 - protein, 302 aa, Streptococcus pneumoniae
KTYKKIGEETKVIEATEPLTILLMGVDTGNVERTETWVGRSDSMILMTVNPKTKKTTMMSLERDILTRIESGNGQAHEAKLNSAYADGGAELAIETIQKMMNIHIDRYVMVNMRGLQKLVDAVGGITVNNILGFPISISDQEEFNTISIGVGEQHIGGEEALVYARMRYQDPEGDYGRQKRQREVIQKVMEKALSLNSIGHYQEILKALSDNMQTNIDLSAKSIPNLLGYKDSFKTIETQQLQGEGEILQGVSYQIVSRAHMLEMQNLLRRSLGQEEVTQLETNAVLFEDLFGRAPVGDEDN

SEQ ID NO: 220 - protein, 403 aa, Streptococcus pneumoniae
AVLPLLAATILASEGKTVLQNVPILSDVFIMNQVVGGLNAKVDFDEEAHLVKVDATGDITEEAPYKYVSKMRASIVVLGPILARVGHAKVSMPGGCTIGSRPIDLHLKGLEAMGVKISQTAGYIEAKAERLHGAHIYMDFPSVGATQNLMMAATLADGVTVIENAAREPEIVDLAILLNEMGAKVKGAGTETITITGVEKLHGTTHNVVQDRIEAGTFMVAAAMTGGDVLIRDAVWEHNRPLIAKLLEMGVEVIEEDEGIRVRSQLENLKAVHVKTLPHPGFPTDMQAQFTALMTVAKGESTMVETVFENRFQHLEEMRRMGLHSEIIRDTARIVGGQPLQGAEVLSTDLRASAALILTGLVAQGETVVGKLVHLDRGYYGFHEKLAQLGAKIQRIEASDEDE

SEQ ID NO: 221 - protein, 316 aa, Streptococcus pneumoniae
IEVPGGSEDIRQVLKVNDTEDKEAGAYQFVTVGVQHATLAHMIYAWLTPFTDIRSAQETTGGSSDVEFMRINQFYMQTSQNMAKYQGLKTAGKDIELKYFGVYVLNVTDNSTFKGILNISDTVTAVNDQTFDSSKDLIDYVSSQKLGDSVKVTYEEDGQTKSAEGKIITLENGKNGIGIGLIDRTEVISNVPISFSTAGIGGPSAGLMFSLAIYTQIAHPDLRNGRIVAGTGTIDRDGNVGDIGGIDKKVVASARAGAAIFFAPDNPVSEEEQKAHPDAKNNYQTALEAAKTIKTDMKIVPVKTLQDAIDYLKNNP

SEQ ID NO: 222 - protein, 277 aa, Streptococcus pneumoniae
GIVFQVINLPSPHIKPKHMLVLYQKIKEEADNYDGVVITHGTDTLEETAYFLDTMEVPHMPIVLTGAMRSSNELGSDGVYNYLSALRVASDDRAADKGVLVVMNDEIHAAKYVTKTHTTNVSTFQTPTHGPLGLIMKQEILYFKTAEPRVRFDLDHIQGLVPIISAYAGMTDELIDMLDLEHLDGLIIQAFGAGNIPKETAQKLESLLQKGIPVALVSRCFNGIAEPVYAYQGGGVQLQKAGVFFVKELNAQKARLKLLIALNAGLTGQALKDYMEG

SEQ ID NO: 223 - protein, 114 aa, Streptococcus pneumoniae
SQLLISEVRYQQQSEQKEWLLFVDQLEVELDRSQFEKVEGNRLYMKQDGKDIAIGKSKSDDFRKTNARGRGYQPMVYGLKSVRITEDNQLVRFHFQFQKGLEREFIYRVEKEKS

SEQ ID NO: 224 - protein, 100 aa, Streptococcus pneumoniae
VEEQIFFMEFEELYRETQKRSVASQQKTSLNLDGQTLSNGSQKLPVPKGIQAPSGQSITFDRAGGNSSLAKVEFQTSKGAIRYQLYLGNGKIKRIKETKN

SEQ ID NO: 225 - protein, 252 aa, Streptococcus pneumoniae
FSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 226 - protein, 262 aa, Streptococcus pneumoniae
KQSASGTIEVISRENGSGTRGAFTEITGILKKDGDKKIDNTAKTAVIQNSTEGVLSAVQGNANAIGYISLGSLTKSVKALEIDGVKASRDTVLDGEYPLQRPFNIVWSSNLSKLGQDFISFIHSKQGQQVVTDNKFIEAKTETTEYTSQHLSGKLSVVGSTSVSSLMEKLAEAYKKENPEVTIDITSNGSSAGITAVKEKTADIGMVSRELTPEEGKSLTHDAIALDGIAVVVNNDNKASQVSMAELADVFSGKLTTWDKIK

SEQ ID NO: 227 - protein, 187 aa, Streptococcus pneumoniae
ALLALASKDKEMAELIINKDHAINQGQSAIELTCARLLALQQPQVSDLRFVISIMSSCSDLERMGDHMAGIAKAVLQLKENQLAPDEEQLHQMGKLSLSMLADLLVAFPLHQASKAISIAQKDEQIDQYYYALSKEIIGLMKDQETSIPNGTQYLYIIGHLERFADYIANICERLVYLETGELVDLN

SEQ ID NO: 228 - protein, 291 aa, Streptococcus pneumoniae
QQEALVETAKHLVKLIKNGDDLIITHGNGPQVGNLLLQHLASDSEKNPAFPLDSLVAMTEGSIGFWLKNALQNALLDEGIEKNVASVVTQVVVDKNDPAFVNLSKPIGPFYSEEEAKAEAEKSGATFKEDAGRGWRKVVASPKPVDIKEIETIRTLLNNGQVVVAAGGGGIPVVKENNGHLTGVEAVIDKDFASQRLAELVDADLFIVLTGVDYVFVNYNKPNQEKLEHVNVAQLEEYIKQDQFAPGSMLPKVEAAIAFVNGRPEGKAVITSLENLGALIESESGTIIEKG

SEQ ID NO: 229 - protein, 444 aa, Streptococcus pneumoniae
VMEETGFSKATLTKYVTLLNDKALDSGLELAIHSEDENLRLSIGAATKGRDIRSLFLESAVKYQILVYLLYHQQFLAHQLAQELVISEATLGRHLAGLNQILSEFDLSIQNGRWRGPEHQIHYFYFCLFRKVWSSQEWEGHMQKPERKQEIANLEEICGASLSAGQKLDLVLWAHISQQRLRVNACQFQVIEEKMRGYFDNIFYLRLLRKVPSFFAGQHIPLGVEDGEMMIFFSFLLSHRILPLHTMEYILGFGGQLADLLTQLIQEMKKEELLGDYTEDHVTYELSQLCAQVYLYKGYILQDRYKYQLENRHPYLLMEHDFKETAEEIFHALPAFQQGTDLDKKILWEWLQLIEYMAENGGQHMRIGLDLTSGFLVFSRMAAILKRYLEYNRFITIEAYDPSRHYDLLVTNNPIHKKEQTPVYYLKNDLDMEDLVAIRQLLFT

SEQ ID NO: 230 - protein, 220 aa, Streptococcus pneumoniae
EQIVKLQNQKVSFVRGASHELKTPLASLRIILENMQHNIGDYKDHPKYIAKSINKIDQMSHLLEEVLESSKFQEWTECRETLTVKPVLVDILSRYQELAHSIGVTIENQLTDATRVVMSLRALDKVLTNLISNAIKYSDKNGRVIISEQDGYLSIKNTCAPLSDQELEHLFDIFYHSQIVTDKDESSGLGLYIVNNILESYQMDYSFLPYEHGMEFKISL

SEQ ID NO: 231 - protein, 306 aa, Streptococcus pneumoniae
KDNKEAELKKVDFILDWTPNTNHTGLYVAKEKGYFKEAGVDVDLKLPPEESSSDLVINGKAPFAVYFQDYMAKKLEKGAGITAVAAIVEHNTSGIISRKSDNVSSPKDLVGKKYGTWNDPTELAMLKTLVESQGGDFEKVEKVPNNDSNSITPIANGVFDTAWIYYGWDGILAKSQGVDANFMYLKDYVKEFDYYSPVIIANNDYLKDNKEEARKVIQAIKKGYQYAMEHPEEAADILIKNAPELKEKRDFVIESQKYLSKEYASDKEKWGQFDAARWNAFYKWDKENGILKEDLTDKGFTNEFVK

SEQ ID NO: 232 - protein, 191 aa, Streptococcus pneumoniae
CSDCDSTFERIGEENCPNCMKTELSTKCQDCQLWCKEGVEVSHRAIFTYNQAMKDFFSRYKFDGDFLLRKVFASFLSEELKKYKEYQFVVIPLSPDRYANRGFNQVEGLVEAAGFEYLDLLEKREERASSSKNRSERLGTELPFFIKSGVTIPKKILLIDDIYTTGATINRVKKLLEEAGAKDVKTFSLVR

SEQ ID NO: 233 - DNA, 41 bp, Artificial Sequence
  Description of Artificial Sequence: Synthetic primer
cgggatccgaattcgagctccgaaaaagaagtcgtctatac

SEQ ID NO: 234 - protein, 167 aa, Streptococcus pneumoniae
SKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 235 - DNA, 42 bp, Artificial Sequence
  Description of Artificial Sequence: Synthetic primer
ctcgagtgcggccgcaagcttttttagaacctcataaacatc

SEQ ID NO: 236 - DNA, 41 bp, Artificial Sequence
  Description of Artificial Sequence: Synthetic primer
cgggatccgaattcgagctccgagaaggagatgagtttgtc

SEQ ID NO: 237 - DNA, 42 bp, Artificial Sequence
  Description of Artificial Sequence: Synthetic primer
ctcgagtgcggccgcaagcttctctttgttcaaaaattgatc

SEQ ID NO: 238 - DNA, 42 bp, Artificial Sequence
  Description of Artificial Sequence: Synthetic primer
cgggatccgaattcgagctccaagcaggatatgaatattatc

SEQ ID NO: 239 - protein, 27 aa, Streptococcus pneumoniae
EKSADQQAEEDYARRSEEEYNRLTQQQ

SEQ ID NO: 240 - protein, 8 aa, Streptococcus pneumoniae
DLKKAVNE

SEQ ID NO: 241 - protein, 11 aa, Streptococcus pneumoniae
  MOD_RES (1)..(1): Lys or Gly
  MOD_RES (5)..(5): Lys or Gly
XTGWXQENGMW

SEQ ID NO: 242 - DNA, 41 bp, Artificial Sequence
  Description of Artificial Sequence: Synthetic primer
ctcgagtgcggccgcaagcttggctttattttcactaccag

SEQ ID NO: 243 - DNA, 40 bp, Artificial Sequence
  Description of Artificial Sequence: Synthetic primer
cgggatccgaattcgagctccaacagcaaaaaagctgctg

SEQ ID NO: 244 - DNA, 45 bp, Artificial Sequence
  Description of Artificial Sequence: Synthetic primer
ctcgagtgcggccgcaagcttttttttgtttttcaagaattcatc

SEQ ID NO: 245 - DNA, 40 bp, Artificial Sequence
  Description of Artificial Sequence: Synthetic primer
cgggatccgaattcgagctccgacgggattaagagcctac

SEQ ID NO: 246 - DNA, 40 bp, Artificial Sequence
  Description of Artificial Sequence: Synthetic primer
ctcgagtgcggccgcaagcttacgtctgcttggtgtggat

SEQ ID NO: 247 - DNA, 40 bp, Artificial Sequence
  Description of Artificial Sequence: Synthetic primer
cgggatccgaattcgagctccgttcgtattgggaagattg

SEQ ID NO: 248 - DNA, 42 bp, Artificial Sequence
  Description of Artificial Sequence: Synthetic primer
ctcgagtgcggccgcaagctttttaaagaaattgacattgtg

SEQ ID NO: 249 - DNA, 41 bp, Artificial Sequence
  Description of Artificial Sequence: Synthetic primer
cgggatccgaattcgagctcccaagaatcatcaacttacac

SEQ ID NO: 250 - DNA, 41 bp, Artificial Sequence
  Description of Artificial Sequence: Synthetic primer
ctcgagtgcggccgcaagcttataccagccattgttaagcc

SEQ ID NO: 251 - DNA, 42 bp, Artificial Sequence
  Description of Artificial Sequence: Synthetic primer
cgggatccgaattcgagctccgagacgacgattaatattaag

SEQ ID NO: 252 - DNA, 42 bp, Artificial Sequence
  Description of Artificial Sequence: Synthetic primer
ctcgagtgcggccgcaagctttaggcgtttaatgtaagactc

SEQ ID NO: 253 - DNA, 42 bp, Artificial Sequence
  Description of Artificial Sequence: Synthetic primer
cgggatccgaattcgagctccaactcagaaaagaaagcagac

SEQ ID NO: 254 - DNA, 41 bp, Artificial Sequence
  Description of Artificial Sequence: Synthetic primer
ctcgagtgcggccgcaagcttccaaactggttgatccaaac

SEQ ID NO: 255 - DNA, 43 bp, Artificial Sequence
  Description of Artificial Sequence: Synthetic primer
cgggatccgaattcgagctccccagctacaaaaacagaaaaag

SEQ ID NO: 256 - DNA, 42 bp, Artificial Sequence
  Description of Artificial Sequence: Synthetic primer
ctcgagtgcggccgcaagcttttgttctgtcgcgccatttgc

SEQ ID NO: 257 - DNA, 41 bp, Artificial Sequence
  Description of Artificial Sequence: Synthetic primer
cgggatccgaattcgagctccaataccaatactgcaaatgc

SEQ ID NO: 258 - DNA, 42 bp, Artificial Sequence
  Description of Artificial Sequence: Synthetic primer
ctcgagtgcggccgcaagctttttagttaaaacgatttggtc

SEQ ID NO: 259 - DNA, 40 bp, Artificial Sequence
  Description of Artificial Sequence: Synthetic primer
cgggatccgaattcgagctcccaatctagtggagttgagg

SEQ ID NO: 260 - DNA, 40 bp, Artificial Sequence
  Description of Artificial Sequence: Synthetic primer
ctcgagtgcggccgcaagcttcccactaatcaaagatagg

SEQ ID NO: 261 - DNA, 40 bp, Artificial Sequence
  Description of Artificial Sequence: Synthetic primer
cgggatccgaattcgagctccatgaaaattgtacttgtag

SEQ ID NO: 262 - protein, 5 aa, Streptococcus pneumoniae
PAPAP

SEQ ID NO: 263 - DNA, 42 bp, Artificial Sequence
  Description of Artificial Sequence: Synthetic primer
ctcgagtgcggccgcaagcttaatacccgattcgaaatcttc

SEQ ID NO: 264 - DNA, 43 bp, Artificial Sequence
  Description of Artificial Sequence: Synthetic primer
cgggatccgaattcgagctccggactgaccaatcgtttaaatg

SEQ ID NO: 265 - DNA, 40 bp, Artificial Sequence
  Description of Artificial Sequence: Synthetic primer
ctcgagtgcggccgcaagctttctaccctccatcacatcc

SEQ ID NO: 266 - DNA, 40 bp, Artificial Sequence
  Description of Artificial Sequence: Synthetic primer
cgggatccgaattcgagctcctggagcaatgttcgcgtag

SEQ ID NO: 267 - DNA, 40 bp, Artificial Sequence
  Description of Artificial Sequence: Synthetic primer
ctcgagtgcggccgcaagcttaaatgttccgatacgggtg

SEQ ID NO: 268 - DNA, 40 bp, Artificial Sequence
  Description of Artificial Sequence: Synthetic primer
cgggatccgaattcgagctccgatgaatatttacgcatcg

SEQ ID NO: 269 - DNA, 39 bp, Artificial Sequence
  Description of Artificial Sequence: Synthetic primer
ctcgagtgcggccgcaagcttaccagcaccacgcaagag

SEQ ID NO: 270 - DNA, 42 bp, Artificial Sequence
  Description of Artificial Sequence: Synthetic primer
cgggatccgaattcgagctccttttcaagtacggtgactaag

SEQ ID NO: 271 - DNA, 42 bp, Artificial Sequence
  Description of Artificial Sequence: Synthetic primer
ctcgagtgcggccgcaagcttcttgaacttgatgccattttc

SEQ ID NO: 272 - DNA, 41 bp, Artificial Sequence
  Description of Artificial Sequence: Synthetic primer
cgggatccgaattcgagctccgataaaaccctttcttctgc

SEQ ID NO: 273 - DNA, 44 bp, Artificial Sequence
  Description of Artificial Sequence: Synthetic primer
ctcgagtgcggccgcaagcttaaatgtgatttctgtaaaaatac

SEQ ID NO: 274 - DNA, 39 bp, Artificial Sequence
  Description of Artificial Sequence: Synthetic primer
cgggatccgaattcgagctccgcccaccgtctctcgcat

SEQ ID NO: 275 - DNA, 41 bp, Artificial Sequence
  Description of Artificial Sequence: Synthetic primer
ctcgagtgcggccgcaagcttcaaaccagacgatctgtgac

SEQ ID NO: 276 - DNA, 42 bp, Artificial Sequence
  Description of Artificial Sequence: Synthetic primer
cgggatccgaattcgagctccatcaagggagctactgccaag

SEQ ID NO: 277 - DNA, 42 bp, Artificial Sequence
  Description of Artificial Sequence: Synthetic primer
ctcgagtgcggccgcaagcttcataccagagatagattgctc

SEQ ID NO: 278 - DNA, 40 bp, Artificial Sequence
  Description of Artificial Sequence: Synthetic primer
cgggatccgaattcgagctccgaagccattctccagctgg

SEQ ID NO: 279 - DNA, 39 bp, Artificial Sequence
  Description of Artificial Sequence: Synthetic primer
ctcgagtgcggccgcaagcttgtcttggacgacttttgg

SEQ ID NO: 280 - DNA, 41 bp, Artificial Sequence
  Description of Artificial Sequence: Synthetic primer
cgggatccgaattcgagctccaacggagattttcaaggagc

SEQ ID NO: 281 - DNA, 44 bp, Artificial Sequence
  Description of Artificial Sequence: Synthetic primer
ctcgagtgcggccgcaagcttctcactagtctcatatatttttc

SEQ ID NO: 282 - DNA, 40 bp, Artificial Sequence
  Description of Artificial Sequence: Synthetic primer
cgggatccgaattcgagctccagcgctcaaaagacaatcg

SEQ ID NO: 283 - DNA, 41 bp, Artificial Sequence
  Description of Artificial Sequence: Synthetic primer
ctcgagtgcggccgcaagcttttgtaactgagattgatctg

SEQ ID NO: 284 - DNA, 43 bp, Artificial Sequence
  Description of Artificial Sequence: Synthetic primer
cgggatccgaattcgagctcccaagaaaaaacaaaaaatgaag

SEQ ID NO: 285 - DNA, 39 bp, Artificial Sequence
  Description of Artificial Sequence: Synthetic primer
ctcgagtgcggccgcaagcttatcgacgtagtctccgcc

SEQ ID NO: 286 - DNA, 40 bp, Artificial Sequence
  Description of Artificial Sequence: Synthetic primer
cgggatccgaattcgagctccgaatctgtagtttatgcgg

SEQ ID NO: 287 - DNA, 40 bp, Artificial Sequence
  Description of Artificial Sequence: Synthetic primer
ctcgagtgcggccgcaagctttgctaattctttgttttcc

SEQ ID NO: 288 - DNA, 40 bp, Artificial Sequence
  Description of Artificial Sequence: Synthetic primer
cgggatccgaattcgagctcctccaaagtagctgactcag

SEQ ID NO: 289 - DNA, 41 bp, Artificial Sequence
  Description of Artificial Sequence: Synthetic primer
ctcgagtgcggccgcaagcttagactcaaggtagtagtctg

SEQ ID NO: 290 - DNA, 39 bp, Artificial Sequence
  Description of Artificial Sequence: Synthetic primer
cgggatccgaattcgagctccgtagatggaaaagttccg

SEQ ID NO: 291 - DNA, 41 bp, Artificial Sequence
  Description of Artificial Sequence: Synthetic primer
ctcgagtgcggccgcaagcttgtcttcttttttacctttag

SEQ ID NO: 292 - DNA, 40 bp, Artificial Sequence
  Description of Artificial Sequence: Synthetic primer
cgggatccgaattcgagctccgaacaccaaacgaaagatg

SEQ ID NO: 293 - DNA, 42 bp, Artificial Sequence
  Description of Artificial Sequence: Synthetic primer
ctcgagtgcggccgcaagcttggctaattccttcaaagtttg

SEQ ID NO: 294 - DNA, 41 bp, Artificial Sequence
  Description of Artificial Sequence: Synthetic primer
cgggatccgaattcgagctcctactatcaatcaagttcttc

SEQ ID NO: 295 - DNA, 42 bp, Artificial Sequence
  Description of Artificial Sequence: Synthetic primer
ctcgagtgcggccgcaagcttgagctgactccgaacctggtc

SEQ ID NO: 296 - DNA, 39 bp, Artificial Sequence
  Description of Artificial Sequence: Synthetic primer
cgggatccgaattcgagctccaaacgctggattgctcct

SEQ ID NO: 297 - DNA, 42 bp, Artificial Sequence
  Description of Artificial Sequence: Synthetic primer
ctcgagtgcggccgcaagcttgctagtttctattctatttat

SEQ ID NO: 298 - DNA, 41 bp, Artificial Sequence
  Description of Artificial Sequence: Synthetic primer
cgggatccgaattcgagctccaccctagcgctggctagtcg

SEQ ID NO: 299 - DNA, 41 bp, Artificial Sequence
  Description of Artificial Sequence: Synthetic primer
ctcgagtgcggccgcaagcttctcaacttttttaagatcta

SEQ ID NO: 300 - DNA, 41 bp, Artificial Sequence
  Description of Artificial Sequence: Synthetic primer
cgggatccgaattcgagctcccttaaaaatattaaacgtac

SEQ ID NO: 301 - DNA, 42 bp, Artificial Sequence
  Description of Artificial Sequence: Synthetic primer
ctcgagtgcggccgcaagcttgattgcattaactctatagtc

SEQ ID NO: 302 - DNA, 40 bp, Artificial Sequence
  Description of Artificial Sequence: Synthetic primer
cgggatccgaattcgagctccaaagatttatatttagaag

SEQ ID NO: 303 - DNA, 44 bp, Artificial Sequence
  Description of Artificial Sequence: Synthetic primer
ctcgagtgcggccgcaagctttttaaagattgaagttttaaagc

SEQ ID NO: 304 - DNA, 40 bp, Artificial Sequence
  Description of Artificial Sequence: Synthetic primer
cgggatccgaattcgagctcccgtattcgccgtgcggcta

SEQ ID NO: 305 - DNA, 38 bp, Artificial Sequence
  Description of Artificial Sequence: Synthetic primer
ctcgagtgcggccgcaagcttgctagtcttcactttcc

SEQ ID NO: 306 - DNA, 40 bp, Artificial Sequence
  Description of Artificial Sequence: Synthetic primer
cgggatccgaattcgagctccgatgattcccgtgaagttc

SEQ ID NO: 307 - DNA, 40 bp, Artificial Sequence
  Description of Artificial Sequence: Synthetic primer
ctcgagtgcggccgcaagcttttcataaacctctcctttg

SEQ ID NO: 308 - DNA, 40 bp, Artificial Sequence
  Description of Artificial Sequence: Synthetic primer
cgggatccgaattcgagctccgctgatcaggtctttgttg

SEQ ID NO: 309 - DNA, 42 bp, Artificial Sequence
  Description of Artificial Sequence: Synthetic primer
ctcgagtgcggccgcaagcttatcaatttcatagcccatcag

SEQ ID NO: 310 - DNA, 40 bp, Artificial Sequence
  Description of Artificial Sequence: Synthetic primer
cgggatccgaattcgagctccattttcaatacagcgaaac

SEQ ID NO: 311 - DNA, 42 bp, Artificial Sequence
  Description of Artificial Sequence: Synthetic primer
ctcgagtgcggccgcaagcttaaatgaagctaacttgaagag

SEQ ID NO: 312 - DNA, 41 bp, Artificial Sequence
  Description of Artificial Sequence: Synthetic primer
cgggatccgaattcgagctcctttagacaaccttctcagac

SEQ ID NO: 313 - DNA, 40 bp, Artificial Sequence
  Description of Artificial Sequence: Synthetic primer
ctcgagtgcggccgcaagcttattagttgcttcatcagcc

SEQ ID NO: 314 - DNA, 40 bp, Artificial Sequence
  Description of Artificial Sequence: Synthetic primer
cgggatccgaattcgagctcctctcgtcaagtcaataaag

SEQ ID NO: 315 - DNA, 41 bp, Artificial Sequence
  Description of Artificial Sequence: Synthetic primer
ctcgagtgcggccgcaagcttcgtcgtcataaaactaaacg

SEQ ID NO: 316 - DNA, 40 bp, Artificial Sequence
  Description of Artificial Sequence: Synthetic primer
cgggatccgaattcgagctccaaacatgcgattgctgttg

SEQ ID NO: 317 - DNA, 42 bp, Artificial Sequence
  Description of Artificial Sequence: Synthetic primer
ctcgagtgcggccgcaagctttaatttctcgttaacaaagcg

SEQ ID NO: 318 - DNA, 43 bp, Artificial Sequence
  Description of Artificial Sequence: Synthetic primer
cgggatccgaattcgagctccacagaggaagctgttcaaaatc

SEQ ID NO: 319 - DNA, 42 bp, Artificial Sequence
  Description of Artificial Sequence: Synthetic primer
ctcgagtgcggccgcaagcttttgttgtaacacttttcgagg

SEQ ID NO: 320 - DNA, 40 bp, Artificial Sequence
  Description of Artificial Sequence: Synthetic primer
cgggatccgaattcgagctccgaggggacgaatcaaaggc

SEQ ID NO: 321 - DNA, 45 bp, Artificial Sequence
  Description of Artificial Sequence: Synthetic primer
ctcgagtgcggccgcaagcttaagtttaacccacttatcattatc

SEQ ID NO: 322 - DNA, 41 bp, Artificial Sequence
  Description of Artificial Sequence: Synthetic primer
cgggatccgaattcgagctccggtcaaaaggaaagtcagac

SEQ ID NO: 323 - DNA, 44 bp, Artificial Sequence
  Description of Artificial Sequence: Synthetic primer
ctcgagtgcggccgcaagcttctttaattcttctgctagaatac

SEQ ID NO: 324 - DNA, 40 bp, Artificial Sequence
  Description of Artificial Sequence: Synthetic primer
cgggatccgaattcgagctccgttcatcaagatgtcaaac

SEQ ID NO: 325 - DNA, 41 bp, Artificial Sequence
  Description of Artificial Sequence: Synthetic primer
ctcgagtgcggccgcaagcttgccagatgttgaaaagagag

SEQ ID NO: 326 - DNA, 43 bp, Artificial Sequence
  Description of Artificial Sequence: Synthetic primer
cgggatccgaattcgagctcctctaattctgttaaaaatgaag

SEQ ID NO: 327 - DNA, 44 bp, Artificial Sequence
  Description of Artificial Sequence: Synthetic primer
ctcgagtgcggccgcaagctttttcgcatttttgcatgcatttc

SEQ ID NO: 328 - DNA, 40 bp, Artificial Sequence
  Description of Artificial Sequence: Synthetic primer
cgggatccgaattcgagctcctcttcaatgaataaatcag

SEQ ID NO: 329 - DNA, 42 bp, Artificial Sequence
  Description of Artificial Sequence: Synthetic primer
ctcgagtgcggccgcaagcttttcgatgacttgtcctgcttc

SEQ ID NO: 330 - DNA, 45 bp, Artificial Sequence
  Description of Artificial Sequence: Synthetic primer
cgggatccgaattcgagctccgaaaatcatcttttgctaaattac

SEQ ID NO: 331 - DNA, 42 bp, Artificial Sequence
  Description of Artificial Sequence: Synthetic primer
ctcgagtgcggccgcaagctttgtgtttgattcggttgaaac

SEQ ID NO: 332 - DNA, 40 bp, Artificial Sequence
  Description of Artificial Sequence: Synthetic primer
cgggatccgaattcgagctcctccaattcaaatggaaacg

SEQ ID NO: 333 - DNA, 40 bp, Artificial Sequence
  Description of Artificial Sequence: Synthetic primer
ctcgagtgcggccgcaagcttaccaaagaagtccaaatgg

SEQ ID NO: 334 - DNA, 43 bp, Artificial Sequence
  Description of Artificial Sequence: Synthetic primer
cgggatccgaattcgagctccaaggggaatgcttcaccattag

SEQ ID NO: 335 - DNA, 41 bp, Artificial Sequence
  Description of Artificial Sequence: Synthetic primer
ctcgagtgcggccgcaagcttttttttattctcaaaaattg

SEQ ID NO: 336 - DNA, 43 bp, Artificial Sequence
  Description of Artificial Sequence: Synthetic primer
cgggatccgaattcgagctccttggttcaggttaatcaaaaac

SEQ ID NO: 337 - DNA, 42 bp, Artificial Sequence
  Description of Artificial Sequence: Synthetic primer
ctcgagtgcggccgcaagcttattttcgtttttaagaatttc

SEQ ID NO: 338 - DNA, 40 bp, Artificial Sequence
  Description of Artificial Sequence: Synthetic primer
cgggatccgaattcgagctccgcgacagctaccaacggtg

SEQ ID NO: 339 - DNA, 41 bp, Artificial Sequence
  Description of Artificial Sequence: Synthetic primer
ctcgagtgcggccgcaagcttttggtatttttctgttaaag

SEQ ID NO: 340 - DNA, 42 bp, Artificial Sequence
  Description of Artificial Sequence: Synthetic primer
cgggatccgaattcgagctccgatagtcaaaaattggttatc

SEQ ID NO: 341 - DNA, 42 bp, Artificial Sequence
  Description of Artificial Sequence: Synthetic primer
ctcgagtgcggccgcaagcttcttccgatacattttaaactg

SEQ ID NO: 342 - DNA, 40 bp, Artificial Sequence
  Description of Artificial Sequence: Synthetic primer
cgggatccgaattcgagctccgcctatgaaggcaaagtag

SEQ ID NO: 343 - DNA, 41 bp, Artificial Sequence
  Description of Artificial Sequence: Synthetic primer
ctcgagtgcggccgcaagcttctttccaagagaaatctttc

SEQ ID NO: 344 - DNA, 40 bp, Artificial Sequence
  Description of Artificial Sequence: Synthetic primer
cgggatccgaattcgagctcctggttagaaaaacataagg

SEQ ID NO: 345 - DNA, 40 bp, Artificial Sequence
  Description of Artificial Sequence: Synthetic primer
ctcgagtgcggccgcaagcttctaataccagctctcattc

SEQ ID NO: 346 - DNA, 41 bp, Artificial Sequence
  Description of Artificial Sequence: Synthetic primer
cgggatccgaattcgagctccatgtttcaaaattgggcttc

SEQ ID NO: 347 - DNA, 42 bp, Artificial Sequence
  Description of Artificial Sequence: Synthetic primer
ctcgagtgcggccgcaagcttacattcttccctacttatacc

SEQ ID NO: 348 - DNA, 41 bp, Artificial Sequence
  Description of Artificial Sequence: Synthetic primer
cgggatccgaattcgagctccaagatctaccagcaaaaaag

SEQ ID NO: 349 - DNA, 43 bp, Artificial Sequence
  Description of Artificial Sequence: Synthetic primer
ctcgagtgcggccgcaagcttttcatcacgactatagtacagc

SEQ ID NO: 350 - DNA, 41 bp, Artificial Sequence
  Description of Artificial Sequence: Synthetic primer
cgggatccgaattcgagctccactagtggagataattggtc

SEQ ID NO: 351 - DNA, 43 bp, Artificial Sequence
  Description of Artificial Sequence: Synthetic primer
ctcgagtgcggccgcaagcttctgtccttcttttacttctttg

SEQ ID NO: 352 - DNA, 40 bp, Artificial Sequence
  Description of Artificial Sequence: Synthetic primer
cgggatccgaattcgagctccgaaggagaaaaattagctc

SEQ ID NO: 353 - DNA, 40 bp, Artificial Sequence
  Description of Artificial Sequence: Synthetic primer
ctcgagtgcggccgcaagctttaggccctccttgttgacc

SEQ ID NO: 354 - DNA, 41 bp, Artificial Sequence
  Description of Artificial Sequence: Synthetic primer
cgggatccgaattcgagctcccaaaacagtaccagtgctag

SEQ ID NO: 355 - DNA, 42 bp, Artificial Sequence
  Description of Artificial Sequence: Synthetic primer
ctcgagtgcggccgcaagcttattcgtttttgaactagttgc

SEQ ID NO: 356 - DNA, 43 bp, Artificial Sequence
  Description of Artificial Sequence: Synthetic primer
cgggatccgaattcgagctccatgttttatacttatttgcgtg

SEQ ID NO: 357 - DNA, 41 bp, Artificial Sequence
  Description of Artificial Sequence: Synthetic primer
ctcgagtgcggccgcaagcttggcagggatgcggataaacc

SEQ ID NO: 358 - DNA, 43 bp, Artificial Sequence
  Description of Artificial Sequence: Synthetic primer
cgggatccgaattcgagctccaaagtaaccagtcccaacatgg

SEQ ID NO: 359 - DNA, 43 bp, Artificial Sequence
  Description of Artificial Sequence: Synthetic primer
ctcgagtgcggccgcaagcttactggatgaagcattgctatac

SEQ ID NO: 360 - DNA, 43 bp, Artificial Sequence
  Description of Artificial Sequence: Synthetic primer
cgggatccgaattcgagctccaaatcaatcatcgaagcgtttg

SEQ ID NO: 361 - DNA, 44 bp, Artificial Sequence
  Description of Artificial Sequence: Synthetic primer
ctcgagtgcggccgcaagcttttgtttcatagcttttttgattg

SEQ ID NO: 362 - DNA, 43 bp, Artificial Sequence
  Description of Artificial Sequence: Synthetic primer
cgggatccgaattcgagctccatgcctaattataaatttgttg

SEQ ID NO: 363 - DNA, 40 bp, Artificial Sequence
  Description of Artificial Sequence: Synthetic primer
ctcgagtgcggccgcaagcttttttctaccctccttttcc

SEQ ID NO: 364 - DNA, 43 bp, Artificial Sequence
  Description of Artificial Sequence: Synthetic primer
cgggatccgaattcgagctccgaagaaaaagctgataaaagtc

SEQ ID NO: 365 - DNA, 42 bp, Artificial Sequence
  Description of Artificial Sequence: Synthetic primer
ctcgagtgcggccgcaagcttgctgaattagaatacgtacaa

SEQ ID NO: 366 - DNA, 41 bp, Artificial Sequence
  Description of Artificial Sequence: Synthetic primer
cgggatccgaattcgagctccacagaggtaaccattaaaag

SEQ ID NO: 367 - DNA, 42 bp, Artificial Sequence
  Description of Artificial Sequence: Synthetic primer
ctcgagtgcggccgcaagctttttcaaagctttttgtatgtc

SEQ ID NO: 368 - DNA, 39 bp, Artificial Sequence
  Description of Artificial Sequence: Synthetic primer
cgggatccgaattcgagctccgcggatggcacagtgacc

SEQ ID NO: 369 - DNA, 40 bp, Artificial Sequence
  Description of Artificial Sequence: Synthetic primer
ctcgagtgcggccgcaagcttatccacatccgctttcatc

SEQ ID NO: 370 - DNA, 43 bp, Artificial Sequence
  Description of Artificial Sequence: Synthetic primer
cgggatccgaattcgagctccaaaacctataaaaaaatcggtg

SEQ ID NO: 371 - DNA, 42 bp, Artificial Sequence
  Description of Artificial Sequence: Synthetic primer
ctcgagtgcggccgcaagcttattatcttcatcaccaacagg

SEQ ID NO: 372 - DNA, 41 bp, Artificial Sequence
  Description of Artificial Sequence: Synthetic primer
cgggatccgaattcgagctccgcagtcttacccttgttggc

SEQ ID NO: 373 - DNA, 40 bp, Artificial Sequence
  Description of Artificial Sequence: Synthetic primer
ctcgagtgcggccgcaagcttttcatcttcatcacttgcc

SEQ ID NO: 374 - DNA, 42 bp, Artificial Sequence
  Description of Artificial Sequence: Synthetic primer
cgggatccgaattcgagctccatagaggttccaggtggttcg

SEQ ID NO: 375 - DNA, 42 bp, Artificial Sequence
  Description of Artificial Sequence: Synthetic primer
ctcgagtgcggccgcaagcttgggattgtttttcaagtaatc

SEQ ID NO: 376 - DNA, 42 bp, Artificial Sequence
  Description of Artificial Sequence: Synthetic primer
cgggatccgaattcgagctccgggattgtttttcaagtaatc

SEQ ID NO: 377 - DNA, 40 bp, Artificial Sequence
  Description of Artificial Sequence: Synthetic primer
ctcgagtgcggccgcaagcttgccttccatatagtctttc

SEQ ID NO: 378 - DNA, 40 bp, Artificial Sequence
  Description of Artificial Sequence: Synthetic primer
cgggatccgaattcgagctccagtcagctcctcatttcag

SEQ ID NO: 379 - DNA, 41 bp, Artificial Sequence
  Description of Artificial Sequence: Synthetic primer
ctcgagtgcggccgcaagcttacttttttctttttccacac

SEQ ID NO: 380 - DNA, 40 bp, Artificial Sequence
  Description of Artificial Sequence: Synthetic primer
cgggatccgaattcgagctccgtagaggaacagattttct

SEQ ID NO: 381 - DNA, 42 bp, Artificial Sequence
  Description of Artificial Sequence: Synthetic primer
ctcgagtgcggccgcaagcttattttttgtttccttaatgcg

SEQ ID NO: 382 - DNA, 42 bp, Artificial Sequence
  Description of Artificial Sequence: Synthetic primer
cgggatccgaattcgagctcctttagccccacccaatctgtg

SEQ ID NO: 383 - DNA, 40 bp, Artificial Sequence
  Description of Artificial Sequence: Synthetic primer
ctcgagtgcggccgcaagcttgtcctgtgcgaaagattgg

SEQ ID NO: 384 - DNA, 41 bp, Artificial Sequence
  Description of Artificial Sequence: Synthetic primer
cgggatccgaattcgagctccaaacagtcagcttcaggaac

SEQ ID NO: 385 - DNA, 41 bp, Artificial Sequence
  Description of Artificial Sequence: Synthetic primer
ctcgagtgcggccgcaagctttttaatcttgtcccaggtgg

SEQ ID NO: 386 - DNA, 42 bp, Artificial Sequence
  Description of Artificial Sequence: Synthetic primer
cgggatccgaattcgagctccgccttactggccttagcctcc

SEQ ID NO: 387 - DNA, 41 bp, Artificial Sequence
  Description of Artificial Sequence: Synthetic primer
ctcgagtgcggccgcaagcttattcaaatccactagttctc

SEQ ID NO: 388 - DNA, 42 bp, Artificial Sequence
  Description of Artificial Sequence: Synthetic primer
cgggatccgaattcgagctccatgaaaccactacttgaaacc

SEQ ID NO: 389 - DNA, 40 bp, Artificial Sequence
  Description of Artificial Sequence: Synthetic primer
ctcgagtgcggccgcaagcttgtgacttggtaaccagctg

SEQ ID NO: 390 - DNA, 40 bp, Artificial Sequence
  Description of Artificial Sequence: Synthetic primer
cgggatccgaattcgagctcccaacaagaagctttagttg

SEQ ID NO: 391 - DNA, 42 bp, Artificial Sequence
  Description of Artificial Sequence: Synthetic primer
ctcgagtgcggccgcaagctttcctttttcaataattgttcc

SEQ ID NO: 392 - DNA, 40 bp, Artificial Sequence
  Description of Artificial Sequence: Synthetic primer
cgggatccgaattcgagctccgtaatggaagaaacaggat

SEQ ID NO: 393 - DNA, 43 bp, Artificial Sequence
  Description of Artificial Sequence: Synthetic primer
ctcgagtgcggccgcaagcttagtgaataataactggcgaatc

SEQ ID NO: 394 - DNA, 40 bp, Artificial Sequence
  Description of Artificial Sequence: Synthetic primer
cgggatccgaattcgagctccgagcaaattgtaaaattgc

SEQ ID NO: 395 - DNA, 40 bp, Artificial Sequence
  Description of Artificial Sequence: Synthetic primer
ctcgagtgcggccgcaagcttcaagctaatcttaaattcc

SEQ ID NO: 396 - DNA, 43 bp, Artificial Sequence
  Description of Artificial Sequence: Synthetic primer
cgggatccgaattcgagctccaaagacaacaaagaggcagaac

SEQ ID NO: 397 - DNA, 43 bp, Artificial Sequence
  Description of Artificial Sequence: Synthetic primer
ctcgagtgcggccgcaagctttttcacaaattcgttggtgaag

SEQ ID NO: 398 - DNA, 41 bp, Artificial Sequence
  Description of Artificial Sequence: Synthetic primer
cgggatccgaattcgagctcctgttcagactgtgattctac

SEQ ID NO: 399 - DNA, 40 bp, Artificial Sequence
  Description of Artificial Sequence: Synthetic primer
ctcgagtgcggccgcaagctttcttacaagggaaaatgtt

SEQ ID NO: 400 - DNA, 42 bp, Artificial Sequence
  Description of Artificial Sequence: Synthetic primer
cgggatccgaattcgagctcctctaaattgcaagccacaaag

SEQ ID NO: 401 - DNA, 43 bp, Artificial Sequence
  Description of Artificial Sequence: Synthetic primer
ctcgagtgcggccgcaagctttgaattccccactaattctatc

SEQ ID NO: 402 - protein, 6 aa, Streptococcus pneumoniae
PKEPEQ

SEQ ID NO: 403 - protein, 4 aa, Streptococcus pneumoniae
PEKP

SEQ ID NO: 404 - DNA, 40 bp, Artificial Sequence
  Description of Artificial Sequence: Synthetic primer
ctcgagtgcggccgcaagcttcgaattcaatgctactagg

SEQ ID NO: 405 - DNA, 41 bp, Artificial Sequence
  Description of Artificial Sequence: Synthetic primer
cgggatccgaattcgagctcctttgattccttggaagaaag

The invention claimed is:

1. An immunogenic composition comprising a fusion protein comprising (i) a biotin-binding protein or biotin-binding portion thereof; and (ii) a therapeutically effective amount of an antigenic polypeptide comprising:
the amino acid sequence of SEQ ID NO: 34; or the amino acid sequence of SEQ ID NO: 190.

2. The immunogenic composition of claim 1, wherein the biotin-binding protein is rhizavidin.

3. The immunogenic composition of claim 1, further comprising a biotinylated polysaccharide.

4. The immunogenic composition of claim 3, wherein the polysaccharide is a pneumococcal polysaccharide.

5. The immunogenic composition of claim 3, wherein the biotinylated polysaccharide is complexed with the fusion protein.

6. The immunogenic composition of claim 3, further comprising an adjuvant.

7. The immunogenic composition of claim 6, wherein the adjuvant is selected from the group consisting of: cholera toxin, complete Freund's adjuvant (CFA), incomplete Freund's adjuvant (IFA) and alum.

8. The immunogenic composition of claim 1, wherein the antigenic polypeptide consists of the amino acid sequence of SEQ ID NO: 34, or the amino acid sequence of SEQ ID NO: 190.

9. An immunogenic composition comprising a fusion protein comprising (i) a biotin-binding protein or biotin-binding portion thereof, and (ii) a therapeutically effective amount of an antigenic polypeptide comprising the amino acid sequence of SEQ ID NO: 190.

10. The immunogenic composition of claim 9, wherein the biotin-binding protein is rhizavidin.

11. The immunogenic composition of claim 9, further comprising a biotinylated polysaccharide.

12. The immunogenic composition of claim 11, wherein the biotinylated polysaccharide is complexed with the fusion protein.

13. The immunogenic composition of claim 9, wherein the polysaccharide is a pneumococcal polysaccharide.

14. The immunogenic composition of claim 9, further comprising an adjuvant.

15. The immunogenic composition of claim 14, wherein the adjuvant is selected from the group consisting of: cholera toxin, complete Freund's adjuvant (CFA), incomplete Freund's adjuvant (IFA) and alum.

16. The immunogenic composition of claim 9, wherein the antigenic polypeptide consists of the amino acid sequence of SEQ ID NO: 190.

* * * * *